United States Patent 11,549,145 (METHODS AND COMPOSITIONS FOR INHIBITING AND TREATING NEUROLOGICAL CONDITIONS) - sequence listing, part 53

SEQ ID NO: 1184 - DNA, 275733 bp, Homo sapiens
tccttgtctttggactctgaaatcttgtatttagtagtagcgctcgtataacttatgcctaagcctgaggtgttagagcagcatgttggaggcctgctgtccctcctggtggaggtgctgacccgcaccttctgctcttgcagttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggttggtgtctcctgagtcatctgctgtgatttattaacatctgggtgagtctgcttcacgttcctcaggtcctgtgcctgtcatccgagcgtggctgtacctgtagctggcgtaagacagcagcagggttgttttgaaccctatttatgaaacagtcagccgtgctgttacatttacaacagatgcagaattacctgcacttgctgactcctggaaactcattggagcttcctgggcagaactctttctgtgtgcaggtgtgaatcaaggctggtgggtaaaagtggctttgccagccttgcactctgcttctgcacctgatattcaagtctcatggcgagctgggtattttcactttaaagatgaacaaaccagattttcagtgacttggtggattgcaaagagttcagacgcctccattcagatcctgctgctgcatgatggctgcgggagctcgggcttcaccgccacacctcgagtgtctcagtctgtgaaatggagatgataacagatgctggccttacaggattgggttgcagattaaatgagataatggacacaaggtgcacagcacagagtctggtgtgaccaccgccctgccaccgcaccaccgggaggcacacaccagacctgctggcttgaagggagctagggaaagacccattccctgggtttccccagcctagagcggtgaccttccctaccttcccagccttaacgttgcagagtgcagggttgccggagcaggtaccagtaaacggtaattggatttttcggaagaaatagcgattttgaaggatattttagcaaacaaggccactttagacaggtagctgaaatctccatctcgctcccagatgacagcctgtaaatagacttagactctggcagatacagaggcctctctctgcctcctgtgaggaaggccaacaaacggaaggatcatgttccacatttgatgagtttgacttttgaatgtgttcctccagcatgtcccatactcctcacagtgctttattgtttgagtcagcaatgcgcaaactataatttagttgttcaatagtcaggtatttttatctaggaatattctatctcctttgcaacaatagatggtacattttgtgagcttctgataaattctttgggaaagaacttttttctgtaacaaggaaagtgcccagcagcgttgagtgtgggggaaagcgcccagcagcgttgagtggggggaagcgcccagcagcgttgagtaggggggaaagcgcccagcagcgttgagtggggggaaagcgcccagcagcattgagtgcgggggaaagcgcccagcagtgttgagtgcaggggaaagcacctagcagtatggagtgggaggaaagcacccagcagtgttgagtaggggggaaagtacccagaagtgttgagtaggggggaaagcacccagcagtgttgagtggggggaaagcacccagcagtgttaagtaggagggaaagtgcccagtggtgttgagtaggggggaaagcgcccagcggtgttgagtggggggaaagtgcccagcagtgttgagtaggtgggaaagcgcccagaagtgttgagtatggaggaaagtgcccagcggtgttgagtgtggggaaagcgcccagcagtgttgagtaggggggaaagcgccaagaagtgttgagtgcgggggaaagtgcccagcggtgttgagtgcaagggaaagcgcccagcagcattgagcacggcagatttcttctctgccctcttcagtccatctccttggagttctgcaaaacagaatttaatttctgttgttctgtcctgaccaaaaccaggctccagcttggaggctgacctcctcgtacacaaagaagtgtgtactgttgctcacgggggacacactgaggtcaagacgggtggacaagcccaaaaggcaggttcatctgaccgcagctctgtgggtaaacgcctgtgcccactgtcgctgtgcagtacgataacacgacttcttttgtatgtgaaatagattcacccaccagtcaagcgtctgtgtccacaacagaaacaaccatctgccatggagatcctgtgccagaagcacttcgtgcaccttctctgtgtcctgtgcacactttatgcaccttctctgtatcctgtgtgctcagtgctattgcgccgtttctcaaatgagaaactgagtcaggagcaggcagtgccccgttctgcgatgcagtgctgcctcccgagcacgagtgccttggaacacaaatcttgcttcaggccaagttagcaggcaggcgtgcgttgtagtgagggccatcttttgttcctagagctgagggtgatggcagcattgaccagcactgggcttagggttgactgtcccaccaccagaaaagaaaattgcaggccaggacccctgatgaacaaagttgcaaaaatcctcaacaaaatactagcaaaccaattcagcagcatacaaaaggatcataccccacctgtgggatgccagggtggctcaatgtgtgcaaatcagtaagtgtagtgcattacgtctgcaaaatgaaggacaaaaccatatgattatctgtgatgcagaaaaggcattggacaaaattcagcatcctttcataacatctctcaacaaattttaggtatagaggaatgtacctcaacacaataaaggccataaatgagaaacccacagctggcaatggagaaaaggtgaaagcttttcctctgagatcagaaagaagacaaggctgcacacattcaccccttctatttagcatagcactggaagctctagccagagcagtgaggcaagaaaaagaaaaggcattcgtataggaaaggaagaagtgaaattgtttgctgatgacacaatcttatatatagaaaagcctaaagactccaccaaaaagcttttagaactaatcaacaaattcactaaatttgcaggatacaaaatcaacacccaaaatcagtagtgattctatataccagacaagaaactatttgaaaaagaaatcaaagactttaataaacttgcttaatagtaacaaagcaaacaatcttatctctgcgtcccgagctaacagaactgactggatttgtgtccagaggttttaagcttttgtttccacgttcttaaaactgggataataacacagttgatgtgttaataacagttgaagattaaatgaggctctgcccagtggctggcacaccctgagtgctcagtaaaggtcttttataattaattttttttattgttcactttcatggtcatgtttcctagaaatatgccacctatttagttatagctaaacaggatgataaaccaaacctcttaacatttgttatctcattcttatccattttacccttttaaaaatgcttttagggccaggcacagtggctcatgcctgtaatcccaacactttgggaggctgaggtgggtggatcgcctgaggtcaggatttcaagaccagcctggccaacatggcgaaactcccatctctactaaaaatacaaaaattagccagacgtggtggcaggtgcctgtaatcccagctactctggtggctgaggcatgagaattgcttgaacctgggagacggaggttgcagtgagccgagatcataccactgcactgcagtctgggtgacagggtgagactccgtctcaaaaaaaataaataaaaataaaaatgcttttgggattgaaaagcgtttattctaagttacttcaaagtcctgtataagaagggtacacaggttgaatatcccttattcaaaatgcttgggaagaagtgtccctgtggacgcgcccaagctcagtctcaagatgctgccgtgcgttccagaactcctaccttcagttattcacgataaacgtgtgacccatgagcttatctaaaatcagagtttaagacgggttgtatctttaacacatatcacagttttctctgagatttgttttgtccttatttgcttgaattttaccttctcaaccttacatggtattgtaggttttgacctccaagactgtatagagtaagttcgtcctctctgtagccttggttttttattgttgttgttaagattcgggacaacccacttacactctgtcttcccaaacaaatggagccctggccccacccatgtctctgtcccggggaatgggactatgagaccatactctgttttgctcccaacccagagaaggtatcccgaggcctccccacccatcctcctgaattgcacctgccaggactgcagggtcctgttggacgctgggaaggaggatgaggcaggagcatggctcagcccagtgagggggtctgtctgggggaaagcctttagaaatccaccgcctattcaagtcacagtgggagctggggaggaaacacggctgctgtgtgtctgagtcggggacgtgcgggcctccctcagagcgccctgacttgctgtgccctgcccgcaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggtaggtggcagcccccacgccgtccaagtgtgtgagtgagtgggcggctgtgcatgctgagtccaccccttttcactcgagtgtccaggaaaatccaggccctctctacggacttcagtgggagggatggtcagaaggtgcgatgtgtgtggtgtcccgttaggacacatctgctcagtgatacccgtgttagaattggttatgaaaaccatagaagcagggcaaacacacatgcatgcacccagacaccatgtgcacacggacacacatgcacacacgctcacatgcaaacacatgcactcacacacgcccagatactgtgtgcacacacacacatgcagacacacgcactcacacatgcccagacactgtgtgcacacacagacacacatgcacacatgcagacacacacactcacacatgcccagacaccgtgtgcacacacagacacacatgcacacacgctcacatgcagacacactctcacacactccctgacactgtgtgcacacatgctcacatgcagacacacacgtactctcacacacgcccagttaccgtgtgcacgcacagacacatgctcacacgcagacacacacatgcactctcacacacgccccaaatgccgtggctccagatctcagcatctctgggcagggctgaagtcccaggctgatgctgttcctgaatttccccgcacacagggcagcctcggggatcaggtcccagccggctgtggccctgagcacatcacttcaccttcctaaacgctgattctgcagctgcaggcgcaggataatagctccaacttcttaaggggtttcagggtgaatgtgacaatgtgagtcaacagcaggagcgccacaggtcacgcctagtctaacacacgctttggttaggagaacgtccccatcgcacaggcaccagggcagaggcacagccagggtccagggtgtttgtgaatgtctgtgttcgtggcaccgtgtgactcagtctcccttcctggacgctagcggtcacttgccatttctgagcgcacgtgaagcctctgtggtttctagaagtgtcggtgctgaacgcacgcccgtttagccttcctcacccgtcagtctcaattacaaaacagagtgcttgagaacgatggaaagctgtaattccatcccactgtataacccctcaccgcccacaagctgccttcgtggccgcggggaccccccccaccccgcttcttgttatctctctgcgcctgtttccctctatcttcagtggacgcaccgtgatttgggggttctgggaactgcttttttataggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagaggtacgtcgcgggccaagggtctgcctgggtttcctgatgtgactcagcccctccccagccccagtcagggatttgcacctagaggcgtcctcagccccaccctgtgccctccacactgagctgtgctgcctttgcacccagcttctctggacccccgtccctgtatgagcccctcccaccgtgataagcagcgtctggtccccggcgcgtgagtcttcatctctgactttgcgtgggtggcttttcctcctgaggtctgcagtaagttagaggtcattccaaataaccacaggcttcaaaatacggaaacaatcattcttttaacacaaatctccctcctgcatctcagaaaactgaagcccagaggcccagcggccttcccagagccacagcctgggccggacagagcagagctggtgcgggacctctcaccgcccaccctttaagcaaacgcttggaaaaatactttaaacattccagatacatggcataatttcaactcaggggagccattttcaaatccatccagctcatgacttctgtattactgaacctcccctccccaaaagtgccttcagggactgagtatggtgagaatcatgttcgcgcttctcacctcattacagccatgtttttgtcgctgctaaactaatgtgttttctccatgcaacttgagtagcagcacagatacgtcaacagtatcaccggggcccttcgttccatgcgtaaacccacacatgcgtaggtgaggcttcttggagctgggtttctctcttcttgaaacacaagtgcccaggaatgccactgccttcatcacaggtgttagaagtcagggcaggctaccccgcccacctttgagactcctccctgccctgaagcttttcctccagccgctgctcccacctgggctggccagaggcctccactgccatccccctggtgccgcgaagcacgtctgtctcccgggtcctctgctggcctctcgcatcccaaagccatgctctgtctctgccgtcccagtggctcccacaaggccctgaaggtcgctgacccccaggcgtgcaggaggaggcattgtatagatgggtgcacccacgtgctggctgaaggcctgcgctggaccttcgttccccgtcagtgactcaagggccttggtgtgggggtaacagcctctcagggtccctctccctctggcatcgtgttctccgctcaacaacaacaaagtccacgaatcaatgagcaaaagtgtcatcgaagcaaggattgcaggccatgtgcctgccatgctcttctggagaacaatactgacaagaatgtgcctcactgctgtgtgccaaggagggttgggttgggtagaaattctcttgctcttggaagattttttgagatggtgaataagttcattatgataatttcctaactttataatgcagtttataatctctgtttaactgaaagtatttcttttttgaaaagaacgctttaccaaaatataaagcaaatactctatgaaagaggaacatcagaatctcagattcaccccgaggtttcccttctcattgcagacttggctttacctacctaaggctgaaggacaattacatggagatattaaacagggagaaccacatcgaaaggtatgtgcagacctcaccctcagatgtgaaaggactaacgaataaagagtgttctttataaggttctgcgtttgagggaaaagacaagttctctatgttctcccacaattcgcttcctctccttcccagtgacaccccaggaatgtcaccagaatgttctggagaagtgctggacacttagagaagggcttgggtgcagccacagcgctgcttcccctggatggtttttcttggagatgtaaattggagttcagtgaacaaaagttcactgtcaaatatgttttgggttaagccacctgaagtcaggttttgctgcaggccgcgttctgacctctccaggcccctttgcctccacgaggggagtgagcagctgcccccggtgtggccatgagtcccgcagggaggaaccctggctcacgtgctgggagcacagcgtcgtgtcgaaaacagtttgcacagttacgcttttcagtcaccagtttgatgttggattgttttacttttcatatctttaaaactcttcccattttttagggactgtctctgtcccaaattgcttgtccctgagataagtgacccatcttgagatctgactcaggagagggggtggtggcttatcaacaagcacgaatgtgcggtcatggttccggcaaagacacaagatctggtggtgatggcctcaaaacacgtggattttaaaatttcattcttagggaaaataaactccccagtggaagagaaaggacaaatcccttgattcggcggggctcctgggccctccgctggcaccagctgcaccctctccacagcaccctgggcttcccgggggccgcaactcactgccgttgaggctccgggtttgcagccgtggaggtagtgaggtcgtggcctagatgagagcccccatcagggctctgccaagggacccctggctctgagctgggctggcactgcggccagagcccctccgcagcttcccactgagtccaaggccctgaggaggctgaggggcagcagcgggggctgccaaacacttccgatgctccagacgccacacaggttttctgagtcttccggtaacaggacagcaccagccaaaacgctttttcctttggttttgatctcttagggtaacgccagttcattgacaaggatccaatctctgacacaactttgagtctctgttcagcggtgtttagggagggagtcggtgcgtagggaacgcagcctgcttggcagaatctgagcctatgccctgggtaggatggggacgtagtgaggagccggtgccacagggcccagactctgccccactgggtacacctgctgcgtccttcaaatccaggcctctcagggcatccatgggaggacacccctcacccagcagccctctgtgtgtcccctgaggaagggccagggctgccccagccattctgctgtggagagctccacagttaccagatggaatcacgtgagcacccgtgtggacggtgtgaccttctgcatttctctttcaggtttgaattgctggaaattttgagttttgactcagtcagaaggagaatgagtgtaattgtaaaatctgctacaggtaaaatttctttttcttttgatttattaagttatacgtggtggttgtgttttattctgatgactaaattctacaggagctttaaggatttagggtttaagaatgatttattctttttttaaaaactatagacaaatcctctcaaaatactaattttttatttttaaaaagtgcaacatttctggaatgctgaggaaggagtcctgggctaaacatccggcacccttgctctgtccatcttttagtgtcgagttggggccactttactgttgaaaattgcttaattccatttgtgaaagttcctctgcccatccctatcccccacccgcttttctccatgcagagctaaatgacataaaatgtttttaaataaccattttcaaggaaaaggtaatgtgggtttgcaaatgtatctataataatgttcaaagttgcaaagtgagctttgttgattggcagttgccgtaacagtgtgtctgtgagaacagcacactcggttcgtgctccggaatgctgggatgagcagtggcggggcacagtcagagccctgtggccgccatgatgttttggtgacccacacggttgggcactctcctgatcctcccactctgacctgtggctgcccctgtccctgacgattgcctctgcagtccaggtggatgcatctgtggtcccctgacctccctgcgaggagctctcccaggcactttgcatcccccaagcacaggtggacgacctcgtctccccccaccctcagcaggtcacgacacatgccacaggtcactcaacaccgcagcccctcaggctcccgcccacagtgctgaggcttgaacgtgcaggcgcccctggctgtttgccctggacaggcagggcccgtgggctccgtctgcagaggccacccctttgcatggccatcacttcctaagagctcccaccgccccctctgaggctctcactcaccttcatcaccaggttgtcctcaagtgtccccagagggcactgcccacagcccccacagtggccttgttccccgcttcctgccgtgggctttcccataggaagggcctttcacccatctgtcctttccacggacggctcaggaagcctctcccggacctcagccccatagcagcgtgcaggacattgctctatggtggagctgtctgtccgtctgcagccactggctgcctgcacgcatcccgaacgcagaaccgatgctcttctcagcaacacgctgacgtcacgccaccctccgccgagtgctcccaaatcctgtgccgttcagagccctccacgcagcgtcagagcagggcttcattaagagctgtgggatctcactcttcattgtttcctaaaaccagacactcccaggctgcatttagctctttggaaagatgcctggcaaacaaccaaacagccactccccggaaccagacaggctggagagcttcatgccagcattttcctaagatgtgccgagtttaattttaacacagtagacagagcagggccatcatcagtgccgtcgggcacccttcggatcaggaccatggtgcctcacttcctaagaccccgaaggagctgtagggggaggcagtgtgactctcggtgacgccctgtgagtcatagcggctctggggtgggcagcagcctcaggagggaggagggtgccatggctgctctggggggctgccgcctgccttcgctggttccttagacacagtcccactgtgtcacacagcatcacctctgagacacgccatcaaatgtgggatgaatccaggctccacagtgagatgtctactgatggtcataggatgaggaacaatctgtgtgtgaatgttgccaggactcccacgaagagcttttgccagccagaccgtgggatcagcaggacagggtctgagaacaggttcagatgcgcgagacttctgtgtgtcagaacccttccccccggctcggatgaggcgcagtcctgagagtctcagccactcggagttatctgggataaacgcatcctgggtgggaagttcctggtccatcccgtcacgtggttttccccgtagcagtcgaatctagctgttgagccatggctggaacatgctgcccgtgacctgcggggctgactcacgtggttttccccgtagcagtcgaatctagctgttgagccgtggctggaacatgctgcccgtgacctgcggggctgaccacggtgcccaagaaggcaagcatcagccaccccggagccgcccctgccgcgcactcaccccggagctggccctgccacacgctcacaaggggtttttgctgcatcctgaatgcccaagacctcagggcattgtgggctatgccgtggaatctttgtaaataacttctgttactatcaaaaggctgaagagccgctggatcactcgaagaatccgggttggaggcatttgtgccatgagaatatccctatccgcactgggacgcctgtggacctcctagggcctctccaaggaactgagagcttgcaggagagacggccctgccatctgaagccagccactcatcagttacttttaagagaagtttgaatatgtaattaagcaaggtgttctgtaagtagtagtcatccccggagaggttcactaattgcactggagttctccctgctgggcggggagaccctgcagccagctcacagctcgtgtttcctcctgggctcagccctgtagggggttgcggctgtcagagccggatctcactgttttggggctgagcagccccaacaggggcctcccatgatgtccgcaggacccttttttatatgtctgtacctcagtcatgtgtgctttcctgggattctccacggtggaattttgaggaaggacttcggaagtcacaggccactcggctgcatcaggccttccctttcaaaggcagatgtgaaatctctcttttgggggatcctgcggatgcttactgcacccaaggtattatgtacgcagtacacagaagaccgactcgaaagaagaaaaggagagtacataagcatattcatctatgaaaaagaaaagcaagcagaaaagatgaaagagaaggaaagtcctaacagtgcaccctcctggagctcctccaggagctgcttccttgatgccctttttccagccatttcggggacatttgctgtcacgcctggctttccatgtccttgagctggtctgtgagacacagtgaaagaccccccaccatgggctcaaactgtggttctatagccctttctcttctccaaatggcagtaagcccttcttggtcccagaggggacagccaccaaccacggctgcacctgcgacacaacccagctgtcttggggacaggatcctgtgtgttcggttatgtcacctgtgtgtgcacggtcttcagttgctcattgtagattaacttttgctctgtcctctgggtttttttattccaaggctgttcctcaccaagtcttcaggctgaaggtgtcctgtgtcttacagtggaattcacaagctgagacagtgggaaagttaagccattcacatgctcttggcatgagttgtgagccatgaaacatgaattttctagtaaaaaatgtgctgttgttcaagaatgcatcattatgtcatttggaccacagttctcattctgaactgtatctgatgaaacaacagcgttggctggaaaccatgggagtcgggaaacggctctgacatcgattgggtagtttaacccccgggccctgcttttctatgctaagcaactgagactctgtggtcacacctctgcagttctgcagagatcctccagggtccaactcccagcctcagcctgctcactcccgtgccctccagcctcagcctccccactctcccgtgccctccagcctcagcctccccactctcccatcccccccagcctcagcctccccactctcccgtgccgtccagcctcagcctccccactctcccgtgccctccagcctcagcctccccactctcccgtgccctccagcctcagcctccccactctcccgtgccctccagcctcagcctccccactctcccgtgccctccagactcagcctccccactctcccgtgccttccagcctcagcctccccattctctcatcccccctgcctcagcctccttactctcctgtcccctccagcctcagcctccccattctctcatccccccccagcctcagcctccctactctcctgtcccctccagcctcagcctccccactttctcatccccccccagcctcagcctccctactctcctgtcccctccagcctcagcctccgtcctcccccatgccctccagcctttgctcggcactggtttgctgcatgtattggcaacacctgtgtcaccaggtgccatcctctctggctgcaggttggcagccacctcagccacatgagcgtcaagtgtagccatgttcccacagcttccctgttggtgtctcaggagttagtgcttcctggcatccaggaaggaaggcaaggcggacccctgttcctactcctgagtcctcgtccaagctccaggccttggatccgggtcgtcagcccgagagcgtcccctccccatgtccctcccaccaccaccctggggaccactgcctgcccactctggggccctctggatttggtccccagtagacttcccgagggccctcagtgtctgggggtctcagggctctgccccgccaggagctgggcatggagcttcctacgcgtgccgctcaggctgctgtggtgtttctcccaccctgccgtcaccgcgccgtagcacggcgtttccctgcacccaggcacaaaccagccgcctggcagagtgccacgtggcttcgcggaccagggatgcttcaggtgcagagggagctctgtgtgtcgggagcacctgcgcccaggcacaaaccagccgcctggcagagtgccacgtggcttcgcggaccacggatgcttcaggtgcagagggggctctgtgtgtcgggagcacctgcgcccaggcacaaaccagccgcctggcagagtgccacgtggcttcgcggaccagggatgcttcaggtgtagagggggctctgtgtgtcgggagcacctgcgcccaggcacaaaccagccgcctggcagagtgccacgtggcttcgccgtccagggatgcttcaggtgcagagggggctctgtgtgtcgggagcacctgcgcccaggcacaaaccagccgcctggcagagtgccacgtggcttggtggaccagggatacttcaggtgcagagggggctctgtgtgtcgggagcacctgcgcccaggcacaaactagccacctggcagagtgccacgtggcttcgccgtccagggatgcttcaggtgcagagggggctctgtgtgtcaggagcaggtgacatcacagcagaactgtcgtggcctttgctgtatgctgcagtgcctggaagagaaactcgctttatctgaggcctgagaagcccacgttcacagcacaagtatgtccacagcgatcacagtgttactggacgtgtgggaaaaaatgacgcaaacgtttcccctgactcttccaagttcagaggtggcccggctgccttgctctgcatgaggacagatgactctccgaaggggatttgtgttcaccttccagcatttcagaaaccaggaccccctttgggtcaccccaacgcccgtcccgagggcattttgtcccctttcgtgtctttcccagagaaaaaacagagtcccggagccaagttcttttcctcgttcctgcctctcctgtggaatttctagggtgtaggaataaaacgaggctttggaggttatctgtgggtttattttttcctgactgtagcgtgttaactggtccattaaaatctttaaaaagctttccacactgctatccctgttttttgttttttaataatggcataattttaaaaaataatctagtcttccccatattgtgattaaactcctcatttttctcattttgtaggagaaatttatctgttttgcaaaggagcagattcttcgatattcccccgagtgatagaaggcaaagttgaccagatccgagccagagtggagcgtaacgcagtggtgagagccgggctggggagggcctcgtggcggtcagctcccctgctgtcaggaaggaattccatgttccacaagttcctggctgggaatggcgtattgtattccttggggaatgtttagaaatcagctgggccagaggcagacagacaggcagcctcagccggcaccgaccccagggggcctccgatacccagccaggcacaggctgtccagccaggcacaggccatctcctccccagccttgcacagggttttattttcgggtgggtgccaggttggttgattgatgttttggggagtcagaattagcacgtttgtggttattgtattggagcaaaaagtctttgtgttgacgtttctagtgatttgcttcaaaacaaatcagcactttcgttttctgttgtgacatcacctgtttgggtttctttccccatctgggtcttaagcttgtatgataaggtttctttccaccacttgttgtatagcaccgcccagcagcccgcacacctgagcctcccactccgtgggtccggctttctgtctttggggctgctgcggtagggggccggcctgagtgtctctcacagcagggcctcccctccccgtcagacgcgctaaagccgggcaacacgtggctggggtggacacgctccctcctgtcagacaccttaactccgggtgatgcgtggctgggtggacatgctccctcctgtgagaggtcctaacgccgagcgacgcatggttgggtggacgtgctctctcccgtcagatgtcctaacgccgagtgacgcacggctgagtgcacatgctccctcctgtgagatgccctaaagctacactgtgcgtggctggggtggacgcactccctcctgtcagacgtcctaaagctgggtgacgcatggccgggtgggcgcgttccctcccatcagatgccctaacgttgggtgatgcgtggctgggtggacgcgctccctctgctccccacgtggctgctttgtcccacggtgtctgcacccttctcccgacaccaccctggggtcttctccctcactccagcccagggcagcacctcctctcacaccgaccttatcatcttttcatgaaaaagaaacagtaactgacaggctctcctcccagaggtccaaaatgacgctggccagagtggctacgcactggaaaacaagacttccaaggctggctctgcaccaaggaaggctgaaccgagagaaccttggactagaggtcgtggtactcagcgctcccttcactgaccatttaaatgtaaagcaatgtttgtcctcgctgtcagtcgcaacacttgattactgtagatgtcagagcattaagaattcctgccgatggacaggagccctttcgctcgcgagcccgtgcgtgcagcagccagagcctgtgaacttcgtggaatgctgtcgacgtgcggatcatcatctttacgttgctattaaaacagctcctggcactacaaagtagctgcgttggagccaacaggaatccataaatcagcagcaggttaaagattgttgaacttctctgtgagggatctggaaaatacatcactgacttccaccagccacagagctgcagggtgggagccgagcgggttcctctgagcagcacaagcgtcctgcgcttcgacacacaatgagcctcagtacaggggcgtgtgggggctcctgagggggcagctccatctgcagctcgctttccaatagcgcgaggctgtgctttgctgtgacgtggtcgccgtgccatgctgagcacacgatggctacaggtcacaggtgactggtcctccatggagggtcttcatggcctgagtaccaaatatcttccacctgctggatccccactgctgctgcccaggagagtaggcgcatggattatgtgaattgtgatgattgtaaagtccacttgctgcttgtttcagaaagtcttcttgagatgtaattgccatacattgatctatacatatttaaaatgcgagagcagcaagggcattgacacacgaacacacaggtggaggctttgcctgctgggaaggggacgcatccctcaccctagagactgtctcgcgccctcatactcccatccctgccaactcccactcgctggagaccaccgctccactcgccgtcactgcagattcgtgcccaccttctggagcttcctatcagcagaatcacaaaaggcggctgttgtatccggcgtctttcactcccataactgctgagactcggccgtgtgggcccgttcatttctgtcgtgaggaacagcagcactcgttcagttgccgagcactagcggtactagttcagcggccgctagtccaagtacctctagcggtactagtccaagtgccgggcactagcagtactaaccagtccagttgccgggtgttagtggtactaaccagtccagttgccgggtgttagtggtactaaccagtccagttgccgggcactaacagtactaatcagtccagttgccgactgctagcggtactagtccagttactgggcactagccatactaaccagtccagttgccgggcactagcagtactagtccaagtgccaggtatcagtggtactaatcagtccagttgccagccgctagcagtactagtccagttaccgggcactagccatactaaccagtccagttactgggcactggtggtacagaccagtccagttgccagccactagcggtactagtactagtccaagtgccgggcagtagcagtactaaccagtccagttgccaggcgctagcagtactaaccagtccagtttccaggcactagtgatactaaccagtccagttgccgggcactagcagtactaaccaatccagttgccagcactagcggtactattcagtccagttgccaggcactagtggttctaaccagtccagttgccggcactatcggtactaaccagtccagttgccagcactagcggtactattcagtccagttgccagcactagcggtactattcagtccagttgccaggcactagtggttctaaccagtccagttgccagcactagcggtactattcagtccagttgccaggcactagtggttctaaccagtccagttgccggcactagcggtactaaccagtccagttgctggcactagcggtactaaccagtccagttgccaggcactagtggttctaaccagtccagttaccaggcactagcggtactaaccagtccagttgccagcactagcggtactattcagtccagttaccaggcactagcggtactaaccagtccagttgctggcactagcggtactaaccagtccagttaccaggcactagcggtactaaccagtccagttgccggcactagcggtactaaccagtccagtttccaggcactagtgatactaaccagtccagttgccggcactagcagtactaaccagtccagttgccggcactagcagcactcgttcatttgccgggcactcgcagtgctagttctttctacggatggaccagtttcttgattcttccgcctgttggcagacattgggttgtttccagttggggctgttttggaagcagctgctgcgggccgcctgctgtgcgtgtctggggctgagccgatgtgtccttttctcctggggaccctcctgtcagagcgtcttcatttctctttccacagcttcccttttctggctgcttttgaggtgtttcgtgatgggatgccttggtggagtgatgctgtgtttctttgctcagccgtgttgagcatctcggatctgcggcgtttcatcaagtttaacatttttcagcaattattctacagatatttttcttccttgctccctttcagcagttccaggacccatgtactcaactgccggatgttgtctcaccgcttacaaaggcttttccctttaaggttttccacgtttctttagagacggtttctgttgccatgtcacgagtttttcccgtgcagcgtctaacctgtcagcaccccacgcaggacacccctctcctcaaacatcggagttttcatgtctagaaattccgccagcgtggttttgtatcctcatgcccctacttaacatggggcgtgtgtgataacgattgcggtgactgtttaaatcctcctcgctaacggatgggacgtgtgtgataacggtggcagtgactgtttaaatcctcctcgctaactgcacccctgctgccagctctggaccagccacagtgttgcacagtcccctcgtttggggcagggacggtgcccctgcgtgatggtggcctgtggccggatgcctgcctgtgggctttgttggatgctgggtatcgtggtcctcctggagatcttaaatcttgttctggggtgtggctgagttcctgggaacagtctgttcctttcaggccatgccttcgtgatgtccagcagacccacagcagtgcctgccccgggtggtgctccccagactgccaggccctgagcgctgtgcctggtgagtggccatgcctcctggcagcaggctgtcccaccctcctcctaatggcttgttgctggcctccaggagcttcctcacagttgcaggtgcttgaggggccgtccacagcctctggcatccactccatcctaggaactctggtgcttgttcccttgacacccaggtctgccccataactcagggaattcactggctccggctacgttcccctgcccgagcctcggcctggaagctctccgggtagtgagctgggcacttgcagggccccctcggttggcagcattttattttgaaataattacagatttaggagaagttaaaataagtagaaagacagtccagaggggcctgtgtgtccttcgagtccagttaatttctcctttcgctggctgtgcttgctgtcatatcgaagaaactgctatgaaatccaagatgatgaagatttgccaccactgtgtttttttctataagttttctagttttagctcttaaatgtaggagtgtaatccatgtttggctaatttttgcatctttcataaagtgagggtcctactttatttccctgcatgcagttatccagttttcccagcaccatttggtgaagactctcctctcccactgagtgatactgacactcttgctgaaaagcatttgattacggtacctggaggtttatttctgggctctctgttccatcccattttctctatgtctgtctttatcccagttcccgctgttttgattactgtcagtttctagcaggctttgaaaccaggatatgtgagtctttcaactttgttcttctgttataaaatggtttggctattctgaacctcttgagatttaataggaattttaggatgggctttttcatttgtgcagaaaatgccactgggggccaggtacggtggctcatacttgtaattccagcactttgggaggctgaggcataaggatcacttgaggccagaagtttgagaccagcctgggaaacatagcaagaccctgcctctacaaaacatacaaaaggaaaatcagccaggggtggaggcacacatctgtggtcctagctactaggcaggatgagatggaagggtcgcttgagcacagaagtttaaagcagtagtgagccgtgatggcaccactgcatgtttccacgggcaactgagtaagaccctgtctcaaaaaaagaaacggaggaagggcgggagggaagagccattgggatgttgataggatttcatttaatcagtagatcactttgggtagtgttgtcatcttaacaatccatgaacatgggatatctttccatttatttaggtattttataatttctttcagcaaactttggtatttttcagccttgagtcttttacctccttggttaaatttattcataagtattttacttttgttgatgctactgaagtggaatttttttttaatttccttttcatattgttcattggtagtgtatagaaatgccactagttttcgtgtgttgactttgtaccctgtgtctttgctgaattcagttagtggggagcacattcttcatggtcttctggatataggatcatgtcatctgcaaataggccttagaaaggcatcctttctaatgtggaaactttctttttctctttatagcctaatcctctcacttagagcatctaatactctgttgaatagaagtggcaaaagcaggcatccctgtcttgttcctgatcctacggaaaagctttcagtccttcaccatggagggtgatgttagctgtaggtttttcttttcttttttttgagacagagttttgctcttgtcgcccaggctggagtgcaatggcacgatctcggctcactgcaacctctgcctcctgggttcaagccattctcttgcctcagcctcccgagtaactgggattataggcatgcaccaccacgcctggctaatttttgtatttttagtagagatggggtttcaccacgttggccagtctggtcttgaattcctgacctcaggtgatctgcccacctcagcctcccaaagtgctgggattacaggcgtgagccatcatgccttgctggttttttcacttaagtggtttttaccacgttgaggaggtttcttctctccccagtttattaagtggttttatcaccaaaaggtgctggttttttttcagatgccttttctgcatcagttgagatgatcatgtgggatttatgtcatgtattgcattgactttcatatgttgactcacttttgcattcctggaataaaccccacttggtcgtggtgtatgatcctctatgtgccattggattcagtttgctagtattttgttgagcatatttgcatctatatttctaagggatattgttctacagttttcttgtagggtatttgtctggctttgttttatgtgctgtgtccagggttttcgtagtacttagcaggaggaatagagaaaagtatttctgttctgtgttaccacaagagaaagtccctgattgacttttaaaagcagcgacatatttatttccaaaagcttctgcttatcactcacagcaacctaagttctgggaccattttgggttattatcctgtaaaaccattttcttgttatgtaatttttctggtttcagactgaagctatatatcttgtatgttttattgcctcttaggaaaagtcagagaattcattctgcaattcgcatttatgtctccaatctgtaacttgatcaacaggtgcacaaaagatctaatttcaaccacttatttattcagcaaacgttgttgagttttggctgtgtgccagggattcagtggtgaagtcagacacagtgcccacagccagagaacccagtgcctaacaatagaggcaaacccgtgagcagaaagctgcaaggtcgtgtgctcagcaggaggtgaggctggggtggctgagcagcgtctgttcagtgctactttcctctgagacgggtccactggcttctcacttattcttgaccaggagacaatatctggaggatgggaaggaaggagttccagaatgttcctggagaacaggactcaggcacacatagaccctgtcttgtgttctgacttcttcaactccccctttcccaacttctggcttttgagagctcaagggccatgacagccgttgacccagtggcaattctgtccacaccagttaagaggtcggaactagtgataaatatgagccttccctgagagttaggagacgcttcatctcatagaacggaaaacattgtttcaactcttacaaaccagcattctgccggattttaaaatggttatttgggaggattatggttcttttactattatcagtagggctggggctgaaggagcagggaaaacggaaggggaacaccctagatgatcaggtgtgaacctctgtgacggtcgcgctcagcagccttgactgatggaatgaagaggttcatctgtaaaccgccccctgtgtggctgcttcagcctctgcccccattccttgtgtcttgctggtggcggctgcattctctctgtatggtaacatccagaatgatgatcacagtaaggaatttgtgattcttgatttcttttgttcctgtgcaaccaatgattttgataaataacctggcaggtttccttcattgtgaaagaacaacctaccttacaaacttcccacataaaacatgtttactttagaaatatcacttgatattacccataaaattacaaatgattatccttaaaaaaaaaaggttaaatttaactctgcatttgtcaaaataaaggaacaaattttatcttttgatagatgactctgatttctgttacttatttccaggctttctagtctgaaaatgctgtaatccataatgattcttggtatttaatgtagacttaaataattcacttgttgatgacttactcctttcaagatttggttggattataatctttctttctttgtttacttagtactgtaagttttgaaagggttacaattcttgggttagttagtctaatgagagaagggatactgggaaggccgtggagcgtaatatttcagcaagtgacaccttgaattcgtgctaaacgctgcattgtgttctgcaggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggtaaagtaaacgcatgcatcccgtcctgagagacaaactgggatgcaggccgacggcccagggcgtgtgagggcgagtggacgggagggaggccatccgcacagccgacggggcgtgtttgctgctcagggagaggctaggtgtcttgctacaccctggagtcatgtcaggaaggtcatgcctgggggatattttgttgtccatgaagaagatgcctgaaagcacactttcccaggaagtagtgaaaatagctttgtcatatcatattatgaacaggcaagatagaagggctcttacaaattctttcttctttttttttaagggatggcatcttggtgtgttgcccaggctggagtgcagtggcaccatcacaactcactgcagtctaaaactcctaggctcaagctgtcctcccttctcagcctcctgagtagctagaacttcaagcacataccaccatgcctggctaattttttatattttttgtagagataggatctcactatgttgcccaggctagtctcaaattcctggcctcaagcaatcctcccacctcagcctctgaaagtgctggaattgcaggcatgagcagtcatgcctgactgtaattactctttagaatggaatcaacaactaactctgttcctaaacttgttgctagttctttccaaatactggtattacttcttagatcattacatactcaatgtgtttatcattacttgaaaaaacttaatgaagtagaaaattacaaaaactaataatcatcataactggcaaaattaccaattacagattttcaggtacctctaaggcaagagctgccagtgtgccccagctccacaatggggactgaaagttgtttgaggctgaggccactaagaaacagtcgtctggtccacatggtgccttccgagctgagtgaaaggcatggatttcagtggtttgtaggaatggaagaaaaaaaatgccccaattgatgagaatgaagcagaaacttcagaaagttcactgggagtttatctcctagaagaggttaaaggcatcaagtttgaaagtctttaagatccatttcggtccaaaactgaaatccttatcactaaccctgcattttctgagcgtgttgaacaaatgttccttgagttctcgatctgaatggagtattaggcgaagtgggaagttttggtttggtggttttgtgttttgttttgaagtcactctcccctgttcagtccagagtaagtgcacagagcaccgtgtaaagaacgcgacttgcacgtgggaaggcttcagagcgcagggccacggccgccgaaaggctttgctgctgggggctgcgtccttgctctagtggccagtcactcacctgctgtctgtccaggagaagaggggtgtccgtaggatggtgtttgcctggggagcagctgggtcgatctttagaggccttggtggaggagcgtggggatgcctccggcagagcagatgggacagagcccctggggcggggggcaggttgacttgactggaatgggaatgtagaagagtggagagttaatgcctggttggcggggggggatctcagtggctttttcgtgatgatacttgcttataaattatttccttataatctccagtcagcaagtgcgaaacatctctgagcctcagcttccttttgaatcgaattgtagggccaggcccggtggagcacgcttgtaaacagggccaggcccggtggagcacgcttgtaatcctcgcaatttgggaggctgatgcaggaggattgattaaggccaggagtttgagcccagcctgggcaatatagtgagatcccatctcttgaatttttttttaattagtcaagcatggtagcaggcacctgttgtcctagctacttgggaggctgaggagggaggatcgcttgagcccaggagttggaggctgcggtgagctgagatcataccactgtaccctagcctgggcaacataaggcgttctctcgttctcttgctcgctctctttctctctctctatatatatatatatgcacacacacatatgtacatacacacacacacacatatatatatacacatacatacacacacataaaattacaggcttttttttcatctatagaatactatgattgtctgatcttgagacttttagctaggaagttcttcccaaaacctaaccagatccttccagttagaatttaaatccattcctttcatactttctagaagcatggcacgttacttcacacgaaagtagtctgaaacttagaaaaaatggaggccccaaagtgaggcagacatggtttgaccccagatctcccaaggagagggcagtggtctgactgctgtcggaagagccgcttacccccgacaccttctgcagcgtctgcaggctttgggttttccatatgtaaataggtgtggtgctagcgtccttactcgtgacatcatggtaagcatgaaagattgcacataggaagtgtcacacaggcctggcatgtggcaagcccatggcacctgttggccatagaatcactagtgttattctcagtattttatattatttagaggtacctggaccccaagtgggttctaagtgacaaacttagaacagtttatacaaaacaaaagacaatcaatattcctgaccaccttgagtccagatcccatctttccatggttgagacatttttggtggtggttataatttcctgaaaccctccccaggtagtgagtcccacctacacacaaaaccgccaggcttgtcagacgtcagtgacacaagacagccctttacttctcacatgtttgatccatgtttatctctctgctgttaggaagtgtttcgctgtgaaacactagttcagaccttcagaagctgcttcagtacttcgtggtgagatcatgagccacagtgtggagtgttttgattttgaggggctacgatattttgacagctttgcaagtttctgcagttccttatttggattcctgggtcagcactgacttttctctatgctgtgtttggttttgcctccctcaggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccgggtaggcagcgcgtccccgcccccacccccacactcccgcaaaaggggcttcagacccagtggccttcacctgcaagtcggggagccgcattgtctctactgggaattcggttctcccctggggcattaatgccagcttcttaggggtcaggtgaacactgggaacaaaacgggctgttttttccagcaattgtgatgtgtctttttcacatatgtgtgtgtatgtgtgtatgttcagtttcacactgccggctaacagatgcaaaaagacatgatggataaaatattttgagtgggataattctcatctgtttctgagacttaggggctctgcttcaggcaccttcaagcatctgctggaggaagtggagatattaataatgcatggttgttcgtctaagacgaagcagtacatgcccaagagttgtttttttcccaagaatattcagtagtttattcagatacattttatcgatgctgtccttactggtgttagatgcattatctgagattacatgttatttgaatcatttcagtttcattcatgtacataaagcgaaagcagctctctaatttacacaaatgttaagttattcataaatagcacagataattccctctacctgatctgcaatctgcagaactccttttagggattggagggttttttttgttgttttttgttttttgtttttgagatggagcctcaatctgtcgcccaggctggagtgcagtgatcttggctcactgtgacctccgcctcccaggttcaaacaattctcctgcctcagcttcccaagtagctgggattaaaagcgctcaccttttaatagagacagggtttcaccatgttggccaggctggttttgaactcctgacctcaggtgatccacccgccttggcctcccaaagtgctgggattacaggtgtgagccaccgcatccagccttcttgtcattttgaaacccagcaaagaggagattatgaccatgttctttccaacttaggtcatccaggcagaaacccaaggacttagctgtaaagactgtgaccaagaaggttgagagtaaagaccaaccaagatcttagaccacaagatgaacgccttcctgttgtttcaaaagtacagggacttaacgagtccacaaagagagtctgcacttgctttacctaaaataggaatgtttcataaaatacactcttaaatgtcgacaaaaggtgttatgttcaatactataaaaattgtattggtaaaacaagaaacactagtttcttaatcccatggatttgtagcatctgtcgatatccaaaaacaatacagtcttctaaaatctatagatttagtgattgagcaatctttctgactcacgtactctaacagactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcaggtgctgcccgcccgtcctcgatagctggtggtcagggcgtccaaaacactgaaaaccttccgttaggtctcaccgcctcagattgttaaacaatctagcagggtaccacctgttaaaaatagaagcaaccgtgatagagatttaaaacgcagatcttgttttgcttgtcgggccagcttctgtgattagtgggtgatgaccagtcagatgtatgacccttccagatgcagtggccaggacagctgccctggctgacttctgttaaaaaaaaaaaaaaaagctatctcaatcactcctgagaatctacactaaaggtgtaagggaagggagctgacattactgagcacctagtgtgtgcctcctacagatacgaatgcatttagtctcaaaataaccctctcagacaaatgagggcaccagctttacaaatgggaataatttgccgaaaaggctgcagatgggaaatgccacgaggattcaacttgtcttgtccatcaaactccaaacgtctcacgcggccatgttcttgtgggaaacgcacacctgaagttttttctttaaatagttttgaaagcactatggaatgtattgtaaacatggatgtctttctggtatcaggaagcctagaaaagttctgactttgttataccacattttagatatgataggccaatttctcttgaactgttcatgaataaatccatcattggtcagagcaaaccagtggttaaggtaaaatgcgtctcacacaaactctggaaaccaaggaggtgaaaagttgagcctttgtgcatgtgggtgcactaatctgtcaatttcactaaaaacacagaaccagggtcctcagaatgacgagcctagagcattcacagaccttccatgtgaggaagacggtttgatgtcctcctctccctcacatgcgtaactgcacataaaccttacagaattacttcccaaatggaacagcaactaaggatttgccattcgctcttcatgtattccatagtacttttttaagttctcaactggcttttgaaacatttcatacaaattaacttgtgtttcagtttcctatcttgaaacaagaaggcacccacgtttccccccatctcttcattcttacagcttgaactgttacatttaggcacatagatgggggggaaaagattataaagaaattgactaaaaacttggaaattatttttacataaaattgtcatatttgattttgcacgttacaaatttgaaaattaaaatagcattaggaatagtttatgtttagaaatagatgctttataccaaatagcttgaagtaccttggaatagtgatcttacagaatgcagggttcacatttgcccctgtatatttaaatatattttcccaggatttacacacttttccatatatttaagtagaggaatataacaataactacaagctacttcatatatctcacatctctactgccaaagtttgtctaccagccttttccagctcacgtcattttaatcatacctcatttcttttactttattttgttttgctttcaatatgaaaaaggttttatcctatatggagaaaacagacagaatgtcgtaaattacctctaagtagttaatttttttatttgcctaggctaacttttcatctttgttatttctgcctagtgaatgaataacctgttcagaagtgaaacagagaagataaattccgcatttctttcttttgcagattgttaaattaatcaaattttcaaaagagcacccaatcacgttagcaattggcgatggtgcaaatgatgtcagcatgattctggaagcgcacgtgggcataggtgagcttcgtccttgctgctggcacatcctggtggccaggtcaccccttcgctagacaaaggcccatggcagcacgcaggtgcattcaggacacccccgtcaccaccctcgtgtgtgaccgggaaggctcatgatgatggtttcatccgttcttctccccgtccctgccctgtgtgtggtgtgcagaaagcatttcttcagctccttcacctccgtcttctaggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataaggtaggagggtcgccgctccccctcacggtgttagcaacaggtcacgcacagggtggcacgacccttgtctgagccacttgatgccacaagaggtcattgatctccgaggagcagcaactgtcagaaaggaaggggtgaatctgattgcagtcatctcttgcttagctgtgactttgctttttacagtttccattacctacagtcaacccatgcccaaaaatatcaaacgcaaaattgcagaaataaacagttcctcaggtttaaattgcatgccattccgagcagcgtgatgaagtctcacgccgtcctgctgtctccttcctgggatgtggcttgtccctttgtccggtgtgccgatgctgtgtgtacactacctgcccctcagtcactctgtagctgtcttggtgatgaggttgacagatcacaagaagaagggtgaatatgacacaataatatattttaagaggaggagggagagaccaaattcatgtaactttgattacggtatattattatagttattctatgttttgttgttactctttcactgcacctactttataaattaaactttatcatgggtgtgtatgtatacgaacacacatacccatctagagcatagacagggttcaggaccatccgcagactctgcatccccccagggtctgggaatgtacccctgaggatgaggagggcctgccgtgccgcgggaggagacccccagcccttttctccccccacagaattgagtgtggaaccagtgagaacctttcaggtggaaatgtttgaggaaggattccttattcactgtgcagttcgattctttcccgtttatactgatacctgcattgccttcttgtttctcttggagctgacaaatttcctctatacgttgtctgtcctgagtggccaaaacgtggtcacatgtgcatttcagttgcccctgaaataagagaaagctttctagaacccattagtgctgttctgccgcacgctgggtgcacgtggatccctcctcccatgtggggtgggccacgtcggtaggtggcggctgcctccctctgtcccgtcaccgaactaacagttatgccttgcctttcagaacgtctgcttcatcttccctcagtttttataccagttcttctgtgggttttcacaacaggtcagtcctagggtcttcagggacaggctgtctgagccttcttttccttcccgcagtgggtggctgctgtggggaggggagacttgggaatgagcagcactccccggcaccacgagggagccagggtgcccagcagcaggcgggggtgaagggtcgggcctggggaggggggccacggagctgaggagttgccgtcctggaggccccttgttccatgtcttctgaaactgccgtggccctgagatgcgggccagtgatgatgtggtctcctcagggcccagcagtgctgggctgggcatcctgatgccactgcaagaattaactccaactcgaggtccttgtggacatgggccaccccggtgcctggcacgttaacacatgcaacgtgcccataggggaagaagacagttcccatccgggaggggtgaaggactccccgggcatctgccctagatggacacctccttctgtcacatgtgtgctcagtggttggcgggccagctgccttcatgggaagtgactgcgaccagagtcactgaagcttgaagatggcaatcagaattgcaaatgttttctgtgacttttttccttttttttttttttcttgaagtttgtgctgatagaatgggatgagtcagtgttaggctttttgccagctgtgactttcatcctgaaatcacagttgatatcacagaccctagtttatattgttaagctttgaaaagcgctctggtctttctatgcatttcagaaagaaaatatatttaatcaaaagatccaaaaagtttgtaacaatgcactgaggtgccacttcttgtgactttcctcttacagactttgtacgacaccgcgtatctgaccctctacaacatcagcttcacctccctccccatcctcctgtacagcctcatggagcagcatgttggcattgacgtgctcaagagagacccgaccctgtacaggtaccatcctccaaacagcctctcctgagagcagagagagtaactaggcagcactctggcagttccttccaatagccacctggcagacctcagttgagggccagaagcattcggcatctgctgatattcttgcttgatcaggagcttgtttaaactggaagcaacatagctcaaatggagattcttcaagtcttgctggatggtttatgctgcatttggaacatctgtgtggagccagtttgcactttcctgtgctttctgacagtcctgagggagctggggtacaagcgtcttcctcgttgtgaccctagggaatctgtggcctaagttatcctttaaaaccatgtgtgttccattcagtgagaaaaaacaaaaattaacagctctggtttcagggtgtcttttctccccgttattttttaaaaataatatggaagagatatttttctgctatttcagaaatgccccccaaggtctctggcagattcaatatgttactgttttccatggtcttttaaattgtattagtccattttcatcctgctgtgaagacatacctgagactgggtaatttatgaaggaaggaggtttaatggactcacagttccacatggctggggaggcctcacaatcatggcggaaggcatgaggagcaaaggcacgtcttacatggtggcagacaggagagcgtgtgcaggagaactttcctttataaaaccatcagatatcgtgagacttagtcactattacgagaacaacatgggaaaaaaccacccccatgactcaatcactgcccaccaggtccctcccatgatgcgtggggatcataggtgctacaattcaagacgagatttgggtgaggacacagccaaaccctatcataaattaaaattttatttttcagataattttacatccatatgcagttgtaagaaataatagattctgtgggccctgatcccatgtcccttagtggtgacacgcaagaaactgcagtccagcatcacatccagtgtactgatgttggtgccgttcacccgttcccttattcagatcacccagctttccctgcacttacgtacatgtgtgtacatgacacgtgtatgtgtgtgttcaattctgtgcagtcttctcacatgcgtgtttcctgcatccaccaccatagccaagaccactcacttccctgcctgggattctgcaggaatccgtgcatcggcctcactgccctcatcagaatatttagccattctgtgggatcttgacggcttggatccaaaagtaatcactgtaggtgattaaggacgatgataaaaaggcaaacttctgagttggttgtacatctttaataaatctaaagaaaatgggaataaatctaagaaaatgggagaagatatactgttctagacatgtgtctgaaaggaatcctgcaaattctgtcttattgaacaggcatctttaataaatctaaagaaaatgggaataaatctaagaaaatgggagaagatatactgttctagacatgtgtctgaaaggaatcctgcaaattctgtcttattgaacaggcataaggtgtcacgtcaggcgtaaggtgtcacagcaggcgtaaggcgtcacgtcaggcgtaaggtgtcacagcaggcgtaaggcatcacgtcaggcgtaaggcgtcacgtcaggcgtaaggtgtcacaagctcggtgaacgtcaggggtgtgccttgtgttctctgttcgttgctttcagaagcagcagcatgtggcagcatctctgtgcctatgacgatattgcagtgaatatgagagagaaaatatctgagcaaaagttagccaaggacatgagtgggtagtgaaatgctggttgtgatgaacatgccacatttgtggccagagcacaaacttgatgtttactggccgtgcacatcttatcccatgaagacaacgtccagggatggccaccccagagcctgggggaggtgccgggccctgattctcgaggacacacgctgtgcacctttctcctcaccagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcaggtcagtacagagctcgattgcgctgacttagctgcttaggaataaagcctcccaagcccatatgatgattttgccaaagcagaattcagtgcagcccatgcagcttcccagcggggtccatcaccacctgcgcagtaattcagtgcaggccacgcagcttcccagcggggtccatcaccacatgtgccgtaattcagtgcagcccgtgcagcttcccagcagggtccatcaccacctgcgcagtaattcagtgcagcccatgcagtttcccagcggggtccatcaccacgtgcacagtaattcagtgcagcccatgcagcttcccagcggggtccatcaccacctgcgcagtaattcagtgcaggccacgcagcttcccagcgggatccatcaccacgtgcacagtaattgagtgcagcccatgcagcttcccagcggggtccatcaccacctgtgcagtagttcagtgcggcccatgcagcttcccagcagggtccatcaccacctgcacagtaattcagcgtagcacatgcagtttcccagcggggtccatcaccacctgcacagtaattcagtgcagcccatgcagcttcccagcggggtccatcaccacctgcacagtaattcagtgcagcccatgcagcttcccagcggggtccatcaccacctgcgcagtaattcagtgcaaaccatgcagcttcccagcggggtccatcaccacctgcgcagtaattcagtgcagcccatgcagcttcccagcggggtccatcaccacctgcgcagtaattcagtgcggcccatgcagcttcccagcggggtccatcaccacctgcgcagtaattcagtgcaggccctgcagcttcccagcggggtccatcaccacctgcgcagtaattcagtgcagcccatgcagcttcccagcggggtccatcaccacgtgcgcaataattcagcatagcacgtgcagcttcccagcgggatccatcaccacatgggcagtaattcagtgcggcccatgcagcttctcagcggggtccatcaccacctgcacagtaattcagtgcagcccatgcagcttcccagcgggatccatcaccacctgcgcagtaattcagtgcaggcctgcgcagcttcccagcggggtccatcaccacctgcgcagtaattcagtgcagcccatgcagcttctcagcagggtccatcaccacctgcacagtaattcagtgcaggccatgcagcttctcagcggggtccatcaccacctgcgcagtaattcagtgcggcccatgcagcttcccagcggggtccatcaccacctgcgcagtaattcagtgcagcacgtgcagcttcccagcggggtccatcaccacctgcgcagtaattcagtgcggcccatgcagcttcccagcggggtccatcaccacgtgcacagtaattcagtgcagcacgtgcagcttctcagcagggtccatcaccacctgcacagtaattcagtgcaggccatgcagcttctcagcggggtccatcaccacctgcgcagtaattcagtgcagcacgtgcagcttcccagcggggtccatcaccacctgcgcagtaattcagtgcagcacgtgcagcttcccagcggggtccatcaccacatgggcagtaattcagtgcggcccatgcagcttcccagcggggtccatcaccacctgcgcagtaattcagtgcggcccatgcagcttcccagcggggtccatcaccacatgggcagtaattcagtgcaggccatgcagcttcccagcggggatcatcaccacgtgcgccataattcagcgtagcgcgtgcagcttcccagcgggatccatcaccacatgggcagtaattcagtgcagcccatgcagcttcccagcggggtccatcaccacatgcacagtaattcagtgcagcccgtgcagcttcccagcggggtccatcaccacctgcgcagtaattcagtgcggcccatgcagcttcccagcggggtccatcaccacctgcacagtaattcagtgcggcccatacagcttcccagcggggtccatcaccacatgggcagtaattcagtgcggcccatgcagcttcccagcggggtccatcaccacctgcgcagtaattcagtgcagcacgtgcagcttcccagcggggtccatcaccacctgcacagtaattcagtgcggcccatgcagcttctcagcggggtccatcaccacctgcgcagtaattcagtgcagcccatgcagcttcccagcgggatccatcaccacctgcgcagtaattcagtgcaggcctgcgcagcttcccagcggggtccatcaccacctgcgcagtaattcagtgcggcccatgcagcttctcagcagggtccatcaccacctgcacagtaattcagtgcagcccgcgcagcttcccagtggggaccatcaccacgtgcgcaataattcagcgtagcacgtgcagcttcccagcgggatccatcaccacatgggcagtaattcagtgcagcccatgcagcttcccagcggggtccatcaccacctgcgcagtaattcagtgcaggcccgcgcagcttcccagcggggtccatcaccacctgcgcagtaattcagtgcagcacgtgcagcttcccagcgggatccatcaccacatgggcagtaattcagtgcggcccatgcagcttcccagcggggtccatcaccacctgcgcagtaattcagtgcagcccgtgcagcttcccagcggggtccatcaccacatgtgcagtaattcagtgcaggccatgcagcttctcagcggggtccatcaccacatgtgcagtaattcagtgcaggccatgcagcttctcagcggggtccatcaccacatgtgcatagctctgggtcactttaaagatcgcattacctgagtgctcagtgttgctgtaaggaaatgtcctgctgaagtttttttttgtttttttgttgttgttgttgagacggagtctcgctctgttgcccaggttggagtgcaatggcgcagtcttggctcactgcaagctccacctcctgggttcacgccattctcctgcctcagcttcccaagtagctgggactacaggcgcccgccaccacgcctggctgactttttgaatttttagtagagacggggttttaccgtgttagccaggatggtctccatctcctgacctcaggtgatctgcccgccttggcctcccgaagtgctgggattacaggcgtgagccaccatgcacggccagcctgctgaggttttcagactttatctctgtaactaacagttcaccatcagtttgttacctagtggtaccattataccatttagacattgcatttttgatgtgggaatgaattccacgttgagcccgtgttagatttccccgagtaccatacttagtcgtcttcctctgtgatgagtagatttgtagttttctagcagacattcactctctggttgtttgcctaacccctgggggtttgttttatttgtatcttgcttttttctttttgccactggcgtcccttcccaccctcagataatgactaccaacacacatatggtaagacaatcatgggtttgtcgtttctctgtgtttttggagtgcattacaaatgaaatatttctcgaaaatattttcaaacgtgaattcctgtgtgctttgtcggtagaaacgctgttagccgctgctgccccacacaccccagagctagctctgtgttagaagggtgtgtgcgcctcctgacgcacatccttgctgtgttccctcggttgccatgtcagggtggcccattgagccagggatgttttccgaattgactggattcatgggagcttccctcgattttaaattaaaggcagcacaggcatgtgtgggaggcccggtggggccctgtgcttcctgagagagccacaccaggcattcggtagatgtcagagaccatccctgcttaaatgcctcaggtatttaactagccgtacaagcagacaccagcgctgacctcggagaaagtccctcttcagcagccccttctgggtgacttctaaacagaaatcggcttcgttccttgtttagcctgacctctctctccctgtgtgtttgtccctcagactgctgggttcaaacacaaaagtcctgctatgtgtcctgtgcaccatttacctgctttagtcgttttcattcctctttactaaacactgctgttatccttcgtcatcacttaaatcagtttttaccaggtctatcttgagaaccaattcaaatattatttcactgttttaaaagctttaagttttctagaacttattctttgtcttcatttattttaattgaataattcctgaatgccaccaggccatgaacgtcatcaaacagagctacctgttgattcttttgtatcttttatgagattttcttccgagttgggcttacgtaagcatctcgcgtagcccttaagagagaactaagaggtagtgtcctgagcactgagattccaggctcctggcggctgccaatggcaatagcaagtcccctttttcccacacttgattttccagttttctctcacaaacaccaccctggttcactacaaccaccctatcagctggacgttcagatcatgtgaaagctgaggaaagagaagttcggacagactagacaccctgtgcggtgtcagctcccgagaggcagggcctgggtcatacccggacgtccggctccagacttcatggtgttgcccagtgcggcctctgggttgctctagttccaaatttcagcgtgaatgtgaacgtgcctcccaagagcccccggagatggacttcaggggcaaggacacgggcgccactgtcctaggagggcagcccggctgtgctcctgaatgaggtgctggcaacgcagtgccaggggcttctctcagccttcctggcagggtctctgcagcgtctccgccttctcggatccctggacccctggcgtgtccgcagtcagctgcacctggtggtcagtgggcactgtggctctgctgccttcctgggatccgaggatttctactagctcctgtttcctggtctcttccggctgtaccctccagcccctggctatgtcctggaaggtaccttgagcccccacggaacccgcgtgcagccccggggtgatgccagcactcagggaacttgggggcagtcctagtggctgacagccctcttggtccttacgtagcaatttggggttggggtgctcacccctgagaatctcccttccaaccaggatactcccaacggggttacagttcagaggccctctgggattgattgttcttgggtgagagctactttgttttaaagacctaaattattctataggaatatctatagatcctgtgtaggattggaggaacaatagaattatggacatctctttcaaaagttcaccaatggagcattttctgcactgacatcgtaagccatagtaacttctcattttgatgccacaaatgagaatgcgaagacaacagttatttgttgaacagcaagacattcctaagtgaacggttaaaagctcggaacgtgctttgatagacgtaggatgcgatgagagcagctgaaacacgagcggtccgcgtatgggccaggtgggaggcagagggatctgcacagggaggggaggcagtggatgccactcatgaccgtgaccttgagaaggcgcaagttatgctggccgtggatgtttttatacatcagagttaaatgggtctggtctgaggactttttgagcagaaagcttctataggaatacccattctcaaaggagggaggaagtgggggcatggggcttagcctgcagtggtggagggtggccagccccagaggcagatctgctgaaggagtgaggctttcgcactggtcaggttcttggctgagatgtgcctgtcacatgaggacagggttccacagaaatcagaaacaggagcttcactggggatggcgttgatgtcacttggaagaaaagggtccctgtgaaaagccctttgaaaaaggagattggtatcccagggatgcctgccacccccagaatctgatggaaataacgaccagcaattgtagtaataaactatccgcacatgttagtccattttcacatggctctgaagagctacctgagacagggtgatttaggaagaaaagaggtttaatcgagccacagttctgcaggctgcataggaagcatcgctggggaggcctcaggaaacttacaatcatggcggaaggcaaaggggaagcaaggcccttctttacaaggctgcaggagagagagagcaaaggggaaaatgctacacactttgaaacaaccagatctcatgagaactcactcgcccaccgtcaacgagatctgcaaggaggacgtccatgattcagtcacctcccaccaggctctccctccaacacacggggattataatttgagatgagatttgggtgaggacacaaagccaaaccacatcatggcagttcacctgggggccccacttcaggccaccaagggaataagagggctttccagagatgcgtttcaggatagctccacagtggactagcttccaaaggacgtggacacaggttagtaatgggtcagcgtttctcaggggccctgaccaaggtgcctgattctggattcacgatagctgtgctttgttcctcacctataaagcttacagctgtggcccatgtgctctgcaggaccaggcatcctgaggcctaactccttatcccagttctgccattaccccctaaacccagggagccccagctgggagcttagaaaggcagtttctcggctcacagcagggagaggggacagtgaggaggccgtgtgagttgactgcagttatcacctgtggcgctgttggtgacacacactgcttcacagggcacccttgagttcatgtcttgctgccatctaactctttcagagttctgtgttgggatggccaaggtgaggcctgggggaggaagaggagagctgggcagcgtcaggggcttttcctccaggcccagctgatgtggttgtctgggtgcaaagccgccctcagctgctgtggaggcaccacttggctgaaagcatcagcttccagttacagcacagcagcctcccgccctccagcaccttgctggccacatgtgcttgtaggctgctgccaagccacagctgttcctagaggcatgatattttcctgccccagaagttaagccacaaagagacggcactttttggtgagtgtgaaacaggcttctcacccgggctctgctgacattggggccagatgtacatcctcgtgggccactgtcgtgtgcactcagcagcccctccacccccccatccaaagctagcagaccccacgccccagaaatgtctccaccacggccaggtgtccctgggggcaaggctgccccagccgagaaccacaagcatgtgtagatctgagtgacactgtaggccaggcatttccaagccagaaggaggaggcccacttctgatcacaatgaggaagtgagggaaaaactgaaggatgtgttgatgggggcccctaagaagcggtgttcactacaaaaggtcctaacacttttttctataatctacaaatgagatgttatcctgttatcccactgaccatgtgggaggactgtagcccacaccctccctcagctaaatcaaggggtatggtgatgggtgtgttgttttggttgaaactgaattctgaagaacagccatttgtattccagctttttaagagacagagtctgtgctctgtcgcccacgttggagtgtagtggcgtgatctctgctcactgcaacctccgcctcccgggctcaagcaattctcctgcctcagcctccctagtggctgagattacaggcaggcgccgctacgcccggctaatgtttgtattcttagtagagacggggtttcaccatgttggccaggctggtctcaaactcttgacctcatgatccgcccacctcggcctcccaaagcgctgggattacaggcatgagccaccacacccggcccgctttttaattctttataaaataaaattccctgcgaggtgcagttcatggaatccgataaactagaaatcgtctgggccacagcgcaggagcgtcccaaaggaaagcaggttctcccgaaacaagtttccagtcgggggttttccccaaggcggggggtggtctgggcagcagccctttctggcctgtgcctcgtgcggtagagaggcgtgctgtcctcacgggtcgggcacgcggtcctcacgggtgtgtctgtgtctgtgctgcgttgccagctggcagctcgtgggtcccactgaccttccctcctccacggccacctgggcaccactgctggcggatctgtggttctggccgcacgcggggcagcctctgtccagccctgtcctgtctgccggcttgtcttctctgtcctgagggaggttccccgagggaagcccccaggcttccccctctgcatgggtgcctggggtgtttcctctgcatttactcgcagaacgttcccgccgctgttcttcaacagcaggcaggagtctgagctgagttcagaagggaacagacacagtctgtgagtttgttcctgaaacccgtggaatgtagctgggtactcaggcaactgtcttttctacgtaaaacacaaaacagaaaaaggaggtttgcgtgtacccgagtttgcattatggatatttaaatgccagctgtgagggagtttttgtgctcagtttgagaccttgggacgtctgttgtggctgagagcattgagcagggccagcgtcaggagcgggcagcaagttgcagataggcaggctctgagcccatcaccaagccacagaactggtggtgggagatgcagccgggaaatgggggcgtcctgccgtgctctggggagttgctgcatcttcttttacgggataataagaaaatatagtgcttatatctttggggtttgaagtgttggcacacaagaaaaatgaggtgtattttctaaaactcttgattgtgaaagagaaaaaaaaatacataaaaacgagatgacttggactattttccccaaacagatatttggaaactggacgtttggaacgctggtattcaccgtgatggtgttcacagttacactaaaggtaagtggtctcgcgctcacgttcctcccccagccacagtgaacccctgcagtgtaggcctcacgcgctctgagctctctgaattataactctgtactgaggctggaagccactctccacccagccttggctggctcctggggcacccctgggcatccttgtcctgctgtttagacaagtaatgcacagccactcagcacacccggccaccccatgtgcaaaccccagagctacaccggaggtaacctcgggagcaagctgcttctttgtgaaagaattcaggctagaattgttttcagtggcaagtagccctccccccagcgccatcaaaatacactttaattgaaacaaattaatgtattttgaaaaatttcactctttaaagttcagtgaaattatatacagaatatatcattatgaaatctcaaaacctatcagactgagtcttaaaaagtgataccaaaacattcctaaggtgattttcttagatagtgatgtaaacaacacctgactctaaagtaactttctggccaggcatagtggctcacacctgtagttccaacactttgggaggccaaggtggatggatcacctgaggtcagcagttcgagaccagcctggccaacatggcaaaaccccatctttactaaaaacacaaaaagtagccgggcatggtggcacgcgcctgtaatcccagctacttgggaggctgaggcacgagaatcgcttgaacccgggaggtggaggttgcagtgagccaagatcgcaccactgcactccagcctgggcgacagagcgagactgtctcaaaaaaattttaagaagtaactttcttcagtagagacataaagaacaccttaatctgaatgactttcttcggtgacgatataaacaacaccttggtctgtggcccgcatgctgccatctgggaaatacatccatggctcccttacctaggacccagggctgtggcgtccccacattcttcctctccactcacactgtgaggtgtggctttgtcttcctgagcagtgtgaggtgtggctttgtcttcctgagcagtgtgagctgtggctttgtctcccgaacggtgtgaggtgtggctttgtcttcctgagcggtgtgaggtgtggctttgtcttcctgagcggtgtgaggtgtggctttgtcttcctgagcggtgtgaggtgtggctttgtcttcctgagcggtgtgaggtgtggctttgtcttctggagcggtgtgaggtgtggctttgtcttcctgagtggtgtgaggtgtggctttgtctccttaatggtgtgaggtgtggctttgtcttcctgaacggtgtgaggtgtggctttgtcttcctgagtggtgtgaggtgtggctttgtcttcctgagcggtgtgaggtgtggctttgtcttcctgagtggtgtgaggtgtggctttgtctccttaatggtgtgaggtgtggctttgtcttcctgagcggtgtgaggtgtggctttgtcttcctgaacagtgtgaggtgtggctttgtcttcctgagcggtgtgaggtgtggctttgtcttcctgagcggtgtgaggtgtggctttgtcttcctgagcggtgtgaggtgtggctttgtcttcctgagccgtgttttgcaggcattgagtcgtcattgctgggtcttgcgtttggtttagtttctcgtcaccccccggctctctgtcctgcccatcacgatcattctcactgctcagatgacaccgttaactgcccttttttttttccttttagcttgcattggacacacactactggacttggatcaaccattttgtcatctgggggtcgctgctgttctacgttgtcttttcgcttctctggggaggagtgatctggtaaatatctgataagtagctgataatctgataaatatcatgtggttgttatttttttatcaagggttgaagacacattttccgtgcggccctgttggttggggcaagtgtttgttgaatggctgctgtgtgctgggtgtcgtggggtcctgggatacagtcgggggcaagacaccggggggttcctgctccggtgacttgcatcttccgggggagaaagacgctaactgataacagcttgtgacgagttatacggaggaacagaccaggattccgcaccaggggacccatgtcagattgaaaggccagaggtgacttttcagaaacagtcatttgaaacctggaagaagagcgccatcatcacagcaagtcccagctggtaaccgcctcccacaacgaggcactggccaggcattcgacaggtcctgtctcactccatcctcacgccccgcagcaagatggggcccaggcatggtggggctggaccttgcccgcagcagcctgactcatcggggagcctctggtttgggggagagcagcaggcacgcaggcccgggcgggaggaggtcctccgtgagtgggagccgtggccagcggagaggggcccggaccaggctgcagagcaggcatggtggcctcctggaccgccggccgtgaggatcctggctcgaggctgtcgtggtcagtcgaggcagagcacagcagagttgagtggctcttttaaaaaccccacggtggctgcgtgttgagctggtgagagcgacataggcagggtggtcagtctagagactgtcgctgtaagccaggaaacgacgctgagtggtatgggcccagggccaggtcccagtctcagccccagcgcagcagcctctgccacagccctctgcagacctggggtcagtagccggcctagggaaagccagcaacccactcaggatccctcagggcccctgacctgggcgggactctcagcccaggaagagtccctccggattctctcgttcagccagcggcccctggtggccccaagttgcattacacagtctcagagatgacagcccagcttggagggtgtcaggcaccctgtcagccccagagaaacctgcttagctctagagagcccagcccggctctggagagcccggccattctaacagccctgaaggcgatggctctgtaagaggaagattccatcccaaacctctctgaccagctcctgggctttgtagccaaggagccacagcccgtcagccttggtagaaccacagcctctcacattgtttcctaaaacattgaccccacgtctttgatgtgctgggagctcaccatgtcaccaccgcttggtgatgagaccccatcctcctgcccgccaccagcaccacgtgggtgcccccagccccatcccaggtctgccagcagctgcgtgtccctcccgttacccaccatgccctgcttccgtttccctcctgttgtccacacaccagtttcactgtgcttcctggagctggggccctatctctgtgtctctgccaccatccgtagtgcctgggatgtgaaaggcgatcaggaaacgttaccggaaggcacgtatagacgtggacctgtgggctcgggctggctgcgggtcactggtccctgcatccttgccagcctccctcatggaggctgacgcagacgtctttgaatcatcctctttctggggagagaagtcattgcttgctctgtactgacgaccagtgctcgggacgtccttcccatccgagacttcaagatagaaaaacatccctatttcaatccctttgtgttttgttttttgttttttttttttttgcttctgtgaaactgaacttcagagacttctatgtcccatttgagatgacttcatagaattccttctcccgttcctcttaccccagcattaccgggaggttcagtgttcattttttatatgataaattcagagcaggctccgtggcttgccaagcaactctcactgacaaaagtgtaaactccctgaacagacggcctctccagtgagtagagaggccagccccagggagtacatgcctcaccagcggcttctcttccctgcccctcaggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccaggtacggagtgtccccagccggggcgggggtgcctcagggccctggccttaggattgggagatgaccgttttgaaagacagtgtgaaaggtttggatttcatgaaacgtgatcagttcaggtatcactaatgagtgtcctgacggtgcatgatgttaaacatcaggtacatttgcgatgaccgatgtctaattttatgtttcaacctaaacagtcatctgaaatgagacacaaataagagaaaaaagactgatgcaaaaggcaaattatttcatgtaaatggaaaccttttttaaaattaatcattactttaaaaggttgaattacataatttttaaggatggtaaatctggctggaaacggtagcatctgtatcaggaaatgctggtattggtggagctgcttattttacacactcccaagttttaggcacaagcagaattctgggtccagggaagacgtgacgatgccgagtgtccccccaggtgcagggtttggcaggtgtgaggacttagctcccggtcccccatccttttcagcagctggcctctgccttcaagctcaaccctaaatcagaggcagtgaccacgacccacctctgctgctttactgggaagcctgcctgtcctcagagggccgctgcacctgtcacggtccctcaggactctattaacaatgcaagttttcaagtttcatccccgaaatttccaatcactccttgaggtggagccctggactgggcagtgctgaagcccaatggggaaatgaggggtgggggcccctggcagtggctgctcctgcagggtgtgaggctccccaggtgggaggaagacggggagtgagtgggggccggggccccagccctgactcactcacgtagctcagacacccgggggctggctcccagcggtgctgctgtgctgggagggaagacaggttgccctcccttggggggcacagcctcacccaccacccacctccaacaatcagaatgggaccctggcttgagagctttcttgggacattggtgccgatttgaaatgttgaaaccgatgccaccagttcccggcactccctccttcatgcctcctgccacagtttgtaaaatcagagcgagcaaaactcgtggtgaagagactgcctctcaatgtagtgaaaatgtccacacacagctccactgactcgggggccacaggcaggagaaacgcagcagaacgtgccagttggctgcttataagaaggtcccactgaggggcctctgtgcaggaggggagacagtgggagcaggagccggggccctggctgagactccgcggcccccagtgcttcaggggaaactcaccggccccaagcagccactcactgcccagccctgcctgtggcccgagaagcagctgtccagtggtggttttctctaagcacggtccttggttactgagctctttagctgtgcagttccacagcgggcacacgtgttcatgacagggctctgtgcatgggacacgtgttcataaccacatcccatacatggggacgtggcagacacacatgtaacaaggacatcaggcacagaagagacagcagggctgggggtctgaccccgagagagagcaggtgcagcttgggggtgtctgctgggcccctagctgtggccacagtggtgtggcttggggtttgcacgagtctcagccccacctggcccctgggtgcatgtggctgcagaggtgcttggtcaaagatgcctgagcaggcaggagttgaactcggggggttaggagggcctctccccgcaggagtctgggctcttccatgcactgtgcacgcagcctccagagtcggggctgccgagggccacgcccccggatgtgtctgaccacaggccctctgctctgcaactcatctccaggatgggtgggcactttgggaatgccagtgaggaccctccccgtcccaccctttgtttagaagcccctgtattgctgtgggtctctgcgtcccacaagagccccgggaatgcttatgaacagctacacagcgggacctgcagaaggcataaagcagggggtgggaggggctggcgggtcacggtggggggcaccagtgtccgcccagagtgaccagaagaacttgcacgtggtggcgagcctctgactaactcagctctgtctcttgtttctctttccttcccatttccttccgtcttccgaccgctttgcctaaatcctcacaccttgttcacacacccctgtgtgcgtggccgctgacctcgggactaagactaagagccagtgcctttctgtcgagcagtcaaccatctttatgctttctcagacttccagcagcctgagtttctgatggaacaaggtgatgctcctctgccttccacgcacctgggatggtagacacggggcagcagggccatgcccatcaccagagccctgagtccacgtgctctgacgcagcgtccaccaggcgctgggtacagcagcctcacgtcgggaagtcccgccaccacttacaccttctcatgcacagactgatcatgggctgtgctttccatcagtcacagttaaccagggtttctccctcagcgtccgtgcagcctcagaacccacctgtgtgagggttcagacacagctgacagcggagagctggccacatgacccctcacacaggtgtcagaggggttcctaagcaggaaggtgtgagagtttgcaattcacaggtcatccaggctctgagctcacacacccttccctctgcagcctgtagagcgtggatcacaaggcctcctccctcacgcacccacttctgtgcccattctgcagctggaaagactgagggcagctaggataacacggtttgctcaggacccatgcacatttcagaaaaggggagccaggctgagccacacaactggagacaaagaggggacggaagtgtttggtgtcaaatgtttgaccaaattccctttttactgttttttaaatgaaaacctcattgtttttcaaaaaagccttctattaataatttgctttaaaaatgacgaccttggcctttctgggcaatgtagaggcgttcacacgccatttttctgcggtggtgtccatgataagagccgagattgcaggggcctgcacgccgtcctgaagtcgcgttctgtcttttagccgtgtgctcctgcaccaaataccgccttcacgcatgcctccaaatcagtgatgctttgaaaatgcatacttggtattactgttttaccaaatgcagcttagaaaaatgcccaaagcagaaaaaggcttcttttccctttaataacatcatcttctatatattttaaacaggatttttaactgacaaaatggtccttttttaagtccaagcaattaatcagaatcaacagttttctaatttagtgtcatcagaatttgttagattaaattgcagaatttcatctcaccatttctgtacttgaagacatttaggatgaaattattaggaacattttaatgactcataagaggtccttaagaaactgattaaatcatgccaactctgagctaaaaataagcattctaacgattcatgtagtttgttgagagctgatttgcttctgagcatgtacggaagctgagcccggctgcgtagagacagtggcacggagtttctcctgccccctgcgaggccttgggccccggcatgacccccacagacagggccggcgtccacacttgaacagaaagcgcctgcagccagcacatgcccggcgcacacgggaacacgccgtggcgccgagaccacctgcgttctgcaaaactttggaggaataaacgtgtcactagtcctcacgtggggcatatgttacttccagtggatggctttcttttaacctgttcctacggaaaagaaaagcatcacaggcctcagatgtatatgttatatatgtgcgatttgcacatatatgcccgtgctggcatctctgcgtatctgcatgcagttcacttctccgtcactgtccccaggaagggtggcagcctcatcctctgtttcctacttctcctcacctgggcgtttgcccattcagacgtgcaattgtgcaattccaagcccgcagttcttcagctcctgtgcttcccttattccttgaataaggctgggctacaagatctcagtggagttctgtgagcacgctggactcaggaaagtccgtcgcagggccctggtagagcggttactggagctcgctgtctgccgtggaagtgggcgtgtggctgaacgtgtggcttcaggattccagcggtgcctggtagaccttccagccgagggacctcagaccctctgcctcccgcgggtgcatggcccgtccctgagcctgtcgctgtctcagttctgggctcgggcccctcatgggagcggccctgctgggacagtgttttcccaagacgccccaagccctcgccctggcagctccatgacaccccatgcagactccaacaggggcttcgagcctcttcctgctggggtcccacggatggtgcaggcagaggcccgagcactcctggtggccccgtgtggcccacgtcgctcagtatctttcctcgccttgcagaggggtgtgaagcacaaggctccagtccaggccgcacagagcagcgatgggcccctcctgaaggacctcctacggcggccaaggcgcagttagctccacgctaggtaactgtgcggctgctggacgccgcccgtgtgctgtgactgtcagacccgtttttcctccaaagttgtgctgtgctgtgctgtctttgataacaaaggttcacggtgagaaagagcagccctctttacacacacatgcatttgctgtcccaggtaagtaacacgcctgagggcaagctgaccacacatggaacatgctgtgcacacacacgtgtgcacactcaccccacacgcacggcacacagcctgaccagacccagcatcgtcagacacaggctcacgatcctggtctttcgggggacacagcttcacttaaaaggcccatcaggaaggaccgtgctttgaaatcaaacgtggttattgcatggtttgtgtggaactggggcccaggcaggtgtgagtgcaggtcttctgtgtgccagccggagcacatagcttgtcgcctctccaacagacatggaggccatgaagacatctgctcctgccagcatccgccgctgccccctggtctaaaagtgggctgacctggggacggcccctcatcagacagatgcgtgctgccggcctcctgccgctccccttgctggtcagacccacagggcccgtgcacatccggggccccagtgggctgtcagaagccatgcaggccccatccgtatggtgacatcctaggcaacatgtcaaggggatgcaagctgggcacgtccagtactaaatcaacccggtccctgtggggtggggcctgccttccctggggcagtgagttcgccttttgttcaagggtctctgggtaccggtatggcgttcgagctcactgcacaggaagccagctacagggaggaagctcgtaggtttcccgtccatggcctgtatccctggggcccctgggttcttccctgggatggtgggacagggggacggtcactctgttggtactgaaaaggagaggccctcattcctagacagagacccctcgcctccatatggcttctctggtggggtggatcccgcccggcctgccctcaggacgagggtgtgtcctgagttgagtctagcagttcctgcaggaggcgatggtagtgagtgcatcccagagtggctcaggtcaccccaggcagccccgtgggtatccctgagactgaccatgtgtctcgttctctcagcagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaagtggtgtgtacattttctgctctgagaaactgtgcagtcagaacacttcgcagcgtgcttctgtgcgggatggaggtggcaagcccagtgggtgatgtgggccctccctggctgttccctcggctgccaccccctgcagggataccaggtgtgccaggtgcagggccctggtgctgactgccctggatgccagtgcctgcacagaaccggaaacaccactgggtttcccaaccttctggtccatccccaccacaagctcctccctgacctctgccaagctcctgcctgccacctcgtgcttggggtctaggtgccccctttccatcccaattttccctcttgaccaaaccccaggctcctccaggcccttcagcctcctgggctctgttggctgaacccagcctttcccactctgaagtagagggcattccctgccccctgccactcccagccctggcagaattctgggtgctgccacggagcccccggaatgccccctggccttggaggccgtggccttgtcccaaccctgacctcaccctctctcgagttccacccagcccggccgtgtcatactctgcagttttgtgtcttgtctggaaacaccaacttcaaaacaccaccaggtcccaacttctgggatcccagctccattggggcacccggagaggggccttggggtggatcctagagcatccctggtggctggtgcctgagtcccgcctggctacatctcctctccctgctcagccacctgcttcccatggagtctcagctcagggccacgtgggaaacaccccgggaggggacagagggcccctggctcgcaggctggaattctaaacatgggactttttctggctcctgaacgccacaaagtcgggggtacttttcacaggcagtgctccgaaggcatctgtggggtgaatgaacctacagctgccctggattctctccgaaatgctttcctctcgttccctggattctcagcatcttcatgtgggcttacctttacctttccagctcgtaaccctgaagccatcttccgtacagctgtctcttcctcttgtagcaggaaaacagataatgctgtgattttgcgggtcatggggagaagaggggaggggcagagcaggctggtcccagggggcggcactagggtgggaaggcctggccctaatgagtgacccaaactcgcttcacctccccctgctctccagacagaagacatgaatcctgaaagcgagatgcccagtgaccctgcccactgcccaaggaggaggaagcctggccctccctgcccatcagggcctcctggggaagccagagggggatgcaagcttgccctccacactggcccatctgtcccgtgccaaagatcttttcttaactgcagatgctaggtcactgggggcctctgtgggtgtttagcaaacatcatcaaccacacaggccacccgaggcccccacagcagatgatgccgcctgtggacctgaatgggagtgtctgtgtgcctgcagcggtgaggatggaggaaggcgtggctcgtgtggcgctgcgtgccccgcgctgatgctggggctcccagagccgcccacgtggcctgtggcgcacttgctcagtggcgggtcctgaggtggacgaggactggccctgtcctgaggaggctgccggtcctttgcacgcgcagtgaacccgctcacctcgtgcagcctgtcctgacgactgctttccacaacagcatagcgtgtggcctgccagtgaacgggcccaggtgtgggagggacgcagggacagaacccacaggagccccttcccggtgtctcgagaggtgtcctcagggcgtcctcggggcatcctcaggtgtcctccgggtgtcctcaggtgtcctcagggtgttctggcatccaccagcctgcccagggcatccgctgctcccccacatcaactgagggctgttccatgccagcctcatactctcacctgggacaggattgctgggagggctcaggggacggggcaaggccagccaagcccagaagggctggagggagagcgaggccggcataaaatggttctcagctcatgtggagccacagatgctggcttggggcagcctccaggctctgacagggaggctggtttgttcaggtgtcctccagtgtcccagcaaaggggacattccagcagcacctggggccaagagagagggaggaggatggagcctggagaagaaataaaagttggaattaaaagttgtttgctgggagaggaagagccatgtgcctatctcaaaagcgtgggtgacatgcgtgcttcctgtgagcgccctgcggaggctcgtctgtgcaccaacaccccggggtctccccaggtgtggcagcaccaccctgtcctccacctgcatctcctctgggcgctctccatgcggcgctggggtcagggcccgccccactgacctccttttagctcggtcgcctctgtaaagaccccatctccaaccaaggccacattctgaggcactgggagttagcactccgacatctctttttggaagacacaattcaacccccaacactccgttctggggggccatggaaatgcctcatccggcttcagggcagtcacacctgggagcagccgcggcctgcggggtggatccgggcctgtgcggcggtggggtggggttggaggggtgtttgaggccatggctgctccttggatgacaacctggaacacaccaggggagctcgcttgccatcggttctgagtggctcaacctgggtgactgcaatggaccgagagggtccgggtcgtccccaacccgcaaaggcatccaggaagccacccggggaccctgctcagagcaaggcagagccagacacacagcaacaggcaagccgccccgcagaggatgagccgaggcagcacgcaccaacacggggctaaagtcagcatctcactcatctcacaaggcttcctgacttcttaagacatcagtggttactctaaaagagaagagcaggccgtggcgggcaggtgacccctcaccgtcgccctgggggaaggagcgggctgtggcggccgggtgacctctcaccgtctctgtggcggcatcactgtctttctgccggccaagccatcggggcagcagaagagtctcaaacagaaacccggctcagctcttgtttctcacctccttgtttcagcaaaattctccccaaaaggtggctatatttgttgtctctgtctccgtacacaccctcatctgcctcccgatctgtggacggcttctgggccctcgtgggacggctgggtcctgtctgtctctgcttctcagcgggccccggcgcaggccaccaccccacctgccctcgtggtctgcgttctttgccttcacagcatgaatctcaccccgatttgaggctgtgtctgtgtacattaacctattttatgtatttttactgagacataagctccaagaagtgagagactttgcctcgctctgggccgagccctgtgtccagcatggggcctggggtgcaggaaggacgcagtgaccatggggctggctggacacagactcagggcccctgcccggctcagcttcccagtgaggattccaggtgctgggtgcctggttgtagccagccagaccaccctggtcagaggtttcgggacaagggctggcaggaagcccttcccatacagctggagcccatgaggccgagcccgacggcacctgggcagtgagaagccaagacctcggcactttcgttctggaggagggggtgagggagggacagtaccgctgtcttgtctaggcagggtttgtgcagatttgggggctggaggaggccagcgtagccctgccctgctccctccagccacccagaactgcagaggcgccaggcccaagtctgcctgtggcgtgtccaacacagaagggcagattccgagacaaaccagggtggctacaggtttacaagggggccctgtggtctttcctctgtaggtgggaggacactgtcgccaccttcctcggctgtgtaaggcgagcacaaaggagtctcccacctgagatacgatcactccttttctttcccgtacagacatctctgtgggagcgatgctttcacataaagcgcttaatctccaatggtaaagtttccaacactaagtcgagacgttggaacaatttggaagcagatgaaccttcctaaactgcttatgggacacagtgaccacacggagatgccctggaaggattccagcctttggggtcacaggcacgggcaccacagcttcccgggtgcctgctacctgagctcgctgtaagtgccgcacggcttacgtggaatccacagaggcagcccgtactcccccctccatgtgcagcgcccagacacgtgtgccgaggctgcaggtgtgctacagtgcggcggccaaccggctttcccctgcagcctcagctcctgcgggatctgctcactggtaggcagtgacgccctggcgggagttgtccctgaggtctctgctcctcctgctgtgctcgcaggggaacctgtttgtgacgtagtctccttgtgccccactgggcttctgaggctgtgaaagctggtggagcacaaagggcttgcccggccctaacaagcctggccccagcagggcaccgcgggcagcctctgatgcgcggctctgggcctttgtcctcggctgaattaatttcctcttgaattgcctcaactttagaatgagccctagccttttctgaagcacacacatcttggggttttgtcctctgtattttcgctgcattggctgccaatgcggaaagctttcatggagaagacgttctggcttcttgtctgtctgtcccctgagggctgcgggccagctccatgcccgtccacggtgtgcaggtggaggcatctttcagggtatcaggtgggaatccgtgcttcctggcaaagtctgttccagtgtggtgcccactgtccatgcgcctgtgggtgtgagcctgcaccctgcacgaatgtgtggagcggggtcgtggctggctggggtcactgcctgtcccctccttttccgcagccacggtgccatctgcttgcacgtcctgcaggagatcctcagggcgggttcccacgggcagcctccctttggacttttattgctcgattaaatgatatttaattcagcctgtctgacagtctgacagaatgtgctatgttaccagagggtcttatgccaacatgagaaagggggcgttggtctccaaaaagacaaacaaacaaaaaacaggtaagaaacaccatgtgggcccactctgacctttttaactgaggcacctttgagaaggaaagcctgttccactccgattctcaaagctcctgaacgcattgctagtgacaatcctgtctccgtggctaattatgtgaagaaacgttactgggttgagggagttcccttgggtttaatttcctgtccctctcaaatcatccctcctccttccctgagcccagcctccccctttcctgcccatgctggcaggttctggcccttcctggacccctctcctgtcccctgcacaggtctctgcagggtttctgcacgctggggagggcaggttccccagtggagccactccctgcgggtctgagtggggcccggggtctctgcacggtcaccgatgctgctgctgctccagggagcgggcttgcaggagcaaggatccagtccctgaacgcacgtgctccccccgggagaaattctgcagccaggcttggtccacgcaccgtcctcccggcccacacaccctcctcccggacctcagtctgtctctgtgtatcacatgcctgttcccagtgttctgacctcaggtgggcacggcgcggtggactgcacttcccgctgcttgcttggttaatgtttacctccctcctgccagagctttgttttcatttcattcaaacaggcttcctctttttacccactaaatggagacattttaaagctccaactgcaagtgctaaagtctatagctgggtccacatcttccatgatttcacctttttatgccactttactttgtttttaagttatcaataagtttccactgaatcttggagacacaagaattaaatggtggggtcttttatagtttttttgttttgttttgtttgttttgcaaacaacttctgctgcactgttaggtaccaaagtgaggccgcgctgacaggggccagcgtcctgtaccgcgacccacagaccagcggctccttacccactccagtactgaggagtgaggtgggttcttgtccctttttaccctaggacctaaacatgggaaaccctagcccttctgatacgtaacaggggcagccctgatttctgctgctaacctagttaactggtaatctgtctgctctttggcatgctgggagctctgtgtgcactaacccgtggaccccaggacgctctgggacggctgcacagatgagaacacaggccagaagggtttgttagtgacttctctgatgtcacaggctggtcagctcagctgggccacattccagcggccccagccctgtcccacgtgccccagctttctcctgggaagctgcagggaagggtccagctagggcgatcccagctagggcgatcccagctgggtccctgtggggcttcagagtggacacaacttccctgccagctggctcggatccaggggggcaggtgggaccccgttttacatgtgagcccaaggaagtgaggcctgggccccagaagacctccgacccgtccccttgtccagccctctcccctctggaaggggccgagggtgaccccaggtggcaggaactgcacccattaggcacgaccccgccccgctgcccgccccggtcacacctccccctgtcgccccctcccccgcctcgggcacggcggggaggagggggaagagggggatgggtgaggagagcaatgggtgggagagggggagagggggagaggggcaggctgttcccatcgccccgcctcgccgcccttccccctccgctctgggctctggcccccgccccgcccccgcccccgggcccctctccgcccctccccctccggcccgcccccgccccgccccgccccttctctctccccgcccagtgtcggcgcagccctgggaggaggcgtcaggacgcgcggacacctgcggggcgcggagctcggcggacgcgggagggcagcaccacgggcggcaggtgcgcgcggggcgggggcctggagggggcgcgggggtgacgggagggggcgcggggcggagccgggcaggaagcgtcgcggtcgctcccggagcggggccgtctcccccgcgtcccccttagcctggctggggacaggcgctgggacccggctcgcggtcagggcggcctgggatcggcccccgcggcccctgcccagcgtcctgcgctgggaacttcgaggcgcctggggggctcgaaatggcagtggaggagaccccgcgagtgtccaggcgcccagggcccctccgcattgtcacgggggccctcacaccccggcaggtgtcaccccctggacgggcttctgccgacgatcccttgggcacctcgtaggaccaccccgggagctctgcccaccccttcctgccagagcgatggggggccagtgtccaggacagcgcctagggacagggctggagggaagggtagcctggggtccggctggggtcgggcccacacctggtggctggggacagtgctggaggggagggtagcctggggtcgggcccacatctgcatctttcatctgcctgcttgtcccgggccagggtccccttggccacaggtccccaaacagacagcgggaaggccgtggagcgcgggctgggcggactcctcctgggagctccttttgacctggcttggttgccgtgggccctctgtggctcttctcccagctgtgggcccctggccttgcttcagacccttatataggatgctgcgggagggctgggccagagggggctctggagcccaggcaggctcactccctggagactcccgcccaggggcgtggcccgcatgaccctcacagagccgggaccccgaaggggttaaggtggcccgggccgcccaggcaggatgtgccggcatggctgtaggaggccccaggatgtgtggccacggggaccgacacggctgaccacaaaaatagaaatgcagtccccagggctgcaggctgcagagtgtcggtgtggtcccctccctggcaagcaggagacccacatggccaggtgggtgctggatgctgggactgaggaggagcctctagcccccaggactcctaacatgcgaactgtggagcgaggggtccagggctggtcgtgagaacggagtgcacacccaggcattgcctgagttctgcagcctccgtgggtagctggggggacgggaccccgggagcctgtggagccctcagtcccaggggggcagtgaggactctggggcaagctgacagctaggtgggcaggagacccgggttttaaggctccctcaggactctccttcagctcttccccatcctgtggggccggctccgccctcccaggtcccaacttcaccgggctgtgcaggggcccaggcgtccccgatttcaccgggctgtgcagcggtcccggtgtccccgatttcaccgggctgtgtaggggcccaggtgtccgtggctcaaacttccacattgggtatccccaagaaccccccacacgtctgtgaaatgaggggggcccctcccctgggggcctgacagaattgctgtgaaacctgagattgtgggaaactgctggaatccgtgaagggtctgcaacgttagacggtgggcttaggaacctgcagactttggcagggaccccgtggcaccacctcccccatcactgtgctgacttcagggcctgcaggcacagccaggtgcagaggggaaggggcacagtcatcatcctcaccaaggtgatggattcgctgcaagatgaaaggtctgtgtgcagcttcacatctgtccttctctggaattcaggtctcttcaccgcccccccgaggcctcctcctgaggtttccctttacctggtccccaaatgggtggtcccagtcacctctgctgtggagatgcacccttgctcacatcgaggaccccagggaagactttgactggaatctgaacgtttattttggaaaggcagcctcttggtgactccaggtcacttcagaagagaggccccccctgtctttacagccatgtaatttgcatttgtaacgtggtgggagaaggcctgggattggcagagggcatggaggagatgagtcgtgtagatagactggccaggaacgccaccggttggcagccttttgtcaccagttgagatgatttgggatcatttttggaggctcctggagcagccacagttagcactgtgaccagaaggatggagttgtaaggttctgggtgcagctcacctttctgttcagcccaccccgcttcactgtctgcaatggctcccaaggacgctgtgagactctcatgtggcaggtgcacggctctgggctgcatcttggtgacagcatccctctggcatcccaatgcaggttcctgagtcccaccacagagcttcccgcctcacagatggaacagggccctgcgtcttcggcaggtactcagtggtgtttctaggttccaacttgagtcatcagtggattccctgtggagggtccttcaggggacagcagggcactggtcaggggccatgcaggctgagagcccaccctgagaggaggccaggccggcagagcacagggccccagctcggagtgcgggtggcagagtctttagtgcgtggccagctggaagcagcagtggcactttgagaatttcaagtcttgtccaggggccttggtggcctctgactcacatggcctgttcatggcaacccccgctttgggaaagctacatcatgagggtcgctcctggcgtcctaaagtgaacctctccgagctttcagccaacggtaggatacgggacacggtatggccaccgagaagcttttggacatctgtgagggccaccatcgtgaacgtggtggtcaggagcccagcatgaaccggactcagttgagcatcagggctgccccagccggctctgcggggttcacaggaagcccactcctcctccccagccatgcctgggatctcctcggagccctgaaaggtcgtccccatggggttccacagcagggacaatgatggctcaagcggccattggaaccagagctgggaagctgtgggacgtcccggatgaaatgtaggatgtaagtccctgttgggggccatgcagccccacctgttgagaaagtgaagagcattactgacatttccatcatgatgtaaggaaatcaaagcacatctagtgagaaagtgatgctgtggagaccggagagggtaaccgtgttttcttcgcagtcaccatcttcacttttcattcattaaagaaatggcagaaagaaagcagaactgactcctgtggggacaggcccacttctgtgtccaggtgggcagactagagtgaggcagagacatggcaggtggagccgtggtgagggtggtgctgactggcagtggggactggagtgagggctgcagtcaggggtgtcggcctggcacccgctctgtgccagggcccagctgacctctcaccctgcagcatcagagacagccctggaggtgccatgtggcccgtccagccccagccccggccccggccccggccctgggtcatggctttgcagccttcactctttagggaaggtctcccagctccccctgtcctagggccgccgcccccacctctactccacgttattattaatactggcgatttacagtggatgacacggtgtcgtgagtggaagccgtgtggcagcggcggggaccttcctatctttagtgcccagtgcctgggatgagacacactgtgtgaccgccagctcactgcttcccccgcatgtgtggccgacgtaaagtccacccagtcctcagcagcttcccccagcacggacaggtgctccacggcctctgggcctctccgcgctctacccgagctggttgcggggcgtgaggtgggcgcgtgtttgttttgttcgcttggaacctgtgtgcggaggaggctgcccacgctgctgctgggtaaaggcaccatccccgtgaaccgagctcggcaggtgccggaactgagtccaggtccagcctttcaccactggccactcgcagcctccctcaggcccatcctgccagacacggcagcagcaggggtaacgcccacggccatgcaggccctgctcctcctgccccagcgcccttccctccccggtggtactcccacccctgggaccgtcagcacttgcctcccctcctccatttgctattcggctgcctgtgtcacttcaccagctattcaggctagaagcccagacggcctccctgccccccaagtccctgagtccccagctgccatcatctccagactctccttgtccatcacacctctgcctcccgcttctctcctcgggatccctccccaccggtcagcatcagctgctctcaggccccaggtgccactcttggccctgagcttctgcccctatcctgcctgacttctcgccacctgcttcaggccctgcacccaccaccaccccatcccaccaccccaccctgtgccccctcccagggagcaccgggcagggccccctccccccatgccgggtctgcccccgcttggtggtggctgctgaacctgcggagaagctggctctccctgggatccgagctcctcggggacaggagcttccctgacatttgtgtcctcggcacctgcgtcataaacgaggaccgagcaaacgagtcacaaagccgtgctgacttggtgcttccgtggggctgggccgagttctagccgcctgtgaccgtgtctgcatctgtagacagatttaattgtgtgtgtgtgtgtgcgaggcgcctcgctcagcccaggaccacaaagcccagggggcctggctctcggtccagccttcggccttcactgctgacggcttctcaaggttttgcccaggggaaagcagacgctccaagggtggcggcgcctgttgggtgccttgtggtcaggccggtcttgggattttgaagagaacagacgtgaacaggactgcgtctggcttcatcatccatcctctcggggcgggaaagtctgttttcttgccctcaggaaaacccactgctggagaaacagcagtttccagactctctctacccacgtatcttggggttaactctggtgtccttcaccacgtgagagctgttgttcgaagcagctggaggagtgagatcctagaggaaggaggaacctttaagcaggggccacacctgccccaagactcctggccccaggtgtcctcacacaacacccaggggtcctcaggaccccggagctgactggcacctgctgcggaagaggatggcctggacctgccctgtggacggagggatcgctgcatcccttcctccaccatgtcagtgtgacgggccgcgcgtgccatctgcagccttcactgggtaaaagtgaaggtccctcacctggatcttttccaccgtatcttgagatcaagtggttaggaatgcttgcagggtcttgcctcatagtggagagaaacagcggaacagccccttgggttggtttctggatggggaggatgtagccctcatgcctggtgtctacagagtccagcttggggacgcgattgcagccaggggcataaacgtgaccgtgcacacctggcctttcattttcccttttggaggtttcagatcacgatcagccagctcatgtttgaaattctctgaggagaatttggaagagaaaaaggacaaaacagcattttgcttttgtttttttaaccagggacatttttcttcctactttttaatcattgaaattagatttaagcaatcagaaaataagcctttagacctgcgccaggttgtcctcaggtctgtgcccctcccggacctttctgcagagatgaagcaggtgcccggacaaggtggtgagcacagctgggtcccagtgccagccactgagggtgggcatgagatgcgcaggcagcctcgtggcaggctctgcaagtcagctggagaacacgccacacgtaaacaaaagacatgtatgaaaaaccacacaggagccaggacgtgtaacaagttctgaacagtagcagcaaagggatgagttgaacactgaggggtgagtgtttgtggggtggtctcgaaggcctgtgccctgatgaacaccaaggggtgagtgtgtttgtggggtgggagtcaaggctgtggagcttgtgtgttgggggaagaggggcgggtggagaagcacagcctctgctgtgaggggcatgggtgtggccctggtgtccccagagtgtttgggacctggactgtgggttggcgatgggtatcaccctgtcctgggcaggcttcgtccttcagggctccatgtggtggggcagtggttctcgggacgggcctgctctccagggccgggcattggtgtttgcaaagctccctggggactgacagcagtggccctgagagcgcctgtggggtggtctgggcacctgcaggtctgacctgagggatgggatggggtttagctgaagacaatgaaagggggagatgtcccagcaggggcctctgagcagggatttcaggttggagggaggcaggcggccccttcccaggggaataccagggcaggagggatttccccagggagctgaggcccaggcagcagcagaactgggcgacaggatgcagtgtgaacagtggcgtggaaagcgacatccctggtggagccaccgataccgtttattttttattttattttttttgagacggagtttcactgttgtgcctaggctggagtgcggtggtgcaatctcagctcactgcaacctccgcctcctgggttcaagtgattctcgtccctcagcctcgtgagtaactgggattacaggtgccggccaccacgcctggctaatttttgtatttttagtagagacggggtttcggcatgttggccaggctggtcttgaaatcctgacctgaggtgattcgccggcgtcggcctcccaaagtgctgggattacaggcgtgagccacaatacggtttatttaagtaaactgttgctgtctttattcctagggaaggggtcctgcgggtgggacgccaacagtgggaagtagcagtgagccataaatgtgctgaaagacagcacggaaaggcaccacaggtcaccgcctgggaggggaagggctgccggcaagtgactctgaggcttcggttggaaatgcagctactagttttctctttacatttaagattcttcccaaaaacttcgtgtaagtttctttgccaaattttcagtgaggaattatgctttaaagtttctggaactcggaggacattctctacttaggggatttagaaatgtttttaggtaatctgaataagcaatcagcactgattttgaaagtttgccagttcggcgaattagatactgaaacctggagaactagggacgtctatgtctttgaaacaggagtctgaatgtcgaggggaaaacctcggttgttgttgtttttcttttcttcagcagcagaagttgataatatgttttgctcctgcgaccctttattctgtgtcagagttatagaagaaggttccttgtgtaagtgaaccctgatacagtggaaattgaccggagaagaatgaatttagtttcaaacatactatcttcactgcagaataaataccacgaaggttgtaactagttatttcggttttgttcagagcaacagttcttaagtctttctgcagcatgacctcatcgtgcttttaaaatcttttttctgcagcctcatgtttgactgttggagatttatcctgtgcaagagacctggaagcaacagttattcttccccacaacggcccaatgaggccaaaaaggaggaaacggatcaccaaattgatgtgtctgacgtcatcaggcttgttcaagacacaccggaggcgacggccatggccacaggtaggcgcctggtgctgcggcctcatttgattttgcaggtctcactgctgatcagacctgtgctgttctttgctattccggtccttttagagattgacaaggtttagatcctgggaatgcatgaccccccaggtagcaggctgtgggaggggcctcgaatgggttcacgtggcttttacctgcccaggtccaagttgggacgacttgcctcaagatgtgtggtcatttgtttgacttggcattggttatctaagtgagtattttaaaatgagtttggctccggttagagatcatgagaaatgtttctttgggttccaaataaagcacagtatacctgaagggaacaatttgtaggctttgcttcattctttagaaacaaaagagctattgtctgaatttgtatgttttcatattaacatggcaaagcctcagctggtctccagaccagtgcccctgcctgggcgtctggaattggctgtaccccgaggtgagagctgggcaggcctggggtgtgagtggcctctccaagctcagcctgacctcctgatccaggccagacaatgcttctctctccagcccctgcctgtctgaatgttctgcatgtattttctaacctgagcaaggggctgagttctctgttcctagttttgcctgcatttaattatttgttgccatttcttcccaaattgattccaaaatttgtcactagacaaacccagtgtgggcactcaccactgagggcaggcgtggatttgatggccgggtgctggcctggcattgcaaaatccatcctctggctggacaggacgtgcaggcttccagcaccaatggggtggccactgagctgagaagggattttgataattctgctgcctgctctaaatctggtgcttttctgggccttgtcctgagctggcatttgcgctgattagtggagtcttgggagttgctgggtcaaggcatcattctgagactttcgcattcagagtccatcctgtccccatcccacggctgctgccctgagggctggtgcccaggaattccctcctgtttcgtgtcttcaggtgagaactgccctggccctgtcttcagagctcagctctgtgtgtctgctgctgtagaaagagattccacctggtgactgccgagtgtctgtggttccctggcccagtggttctgggccacaacttgtgtagactcttgcacttggaaacgcaggctgttggtttagagctggctggctggggggctgcgtttcggtatagtcaccccagtcagggtatgtgcttagttctgcgggattaagaatttgatttccatcacttcccttgtcagtgactgtcacgaatgagaggtgaggactgagcctcttgggacctctcacggactgagaaccaggtgctctcattattccctggcacaccgcctgcttctctgggatgtacacacctgagaaaccctgtgagcgaggagacagctacttcctacaacagtgaagcggggctgtcaggacagtgctgcacacagcttagctgttgtgcagggggcttcagaagagggcaggagtgaggggctacttagcgcgtgcagacagctggctgccctgacctctgcaactggaaggttgctgagtcttcccgcgctcagcttggctgtgaattaactgcccgtggccactcagaacctcggactggtgcctttccctgagcgcccaagtctcgcgtggaccagctctggggactgaggagctggccgcggttagggttagggttagaggttaaggttagggttaggggttgggactggggtaggggtaggtgttaggggtaggggtagcgtttggggtaaggcagatttaggactagggttagggaaccctcacaactgaaccaagtgctcctattatttctcaacgtaccgagctctcccaggctcaggagcatgtcagggtccaccgtgcaccagccgtggagcagagcctgggcccacgctctggctttgttcctgcccctgctgaccccacaagcttgggtgggttgagaagcctctgcagtgtgggcagcagtagtagcatccaggcagctgctgtgaggagcccagacatgtggctggtcagagcacccacttagcaagccgtggctcttaataatgtcacatctgacttcttcctcccctaactcgcaaaacctctctgatccctgagtcctggaggcccagggctggctttaccaagaaagccctttaggcagcttccctccaaccctggactccaggggattggaagataatctgcttagagttctgagcggtgaagcccttctggctgtccttgcctcgtctgctctgtggaaagagaagcgcacggcgtggactgcggcctgcgggagaaccgcactcggctctcaggccctgcctgcaccacacctgctccgtctccaggtgacctggggccttggcaatgtcctagcccagctggctggagacagttggtggtgatgaaacctgtttgtatcagaacaatttcgaaatcagtgatagttttttttgtcataaaatagacacccatgaaatgtaccattttaactactgtcaagtgtagagttccctggtatgaaatatactcacactgttgtacaaccaccaccagtgtccatcttcagaactttctcatcttctctgaaactctgtccccattaaacacccgctcccattccccctgttggaaataagaactcggagttgcaaagaaaacgagcacgtaaataaaggatttctcaacaaggcaaatttacttctgcagaagggtgctgctcactcttctggtcgctgcaagagcacaccgaacaaaggaggagagggggttttatccctaacgcagccagtccctgctactgtgtccagtccccattggctggagtcagactacacaatctcagctgatcctgattggctacttcaaatggaacaggggtgggggctacagtggtgggaagagcagtttcagaactaaaggcaccaaataaggaatagatgtgggttgttacagattgggaatggatgtgggttacagattgggaacggcacgaagtttgtttaccgtaactaggggcaaggaggcaaggaagttaggctttgagcataaaggacaaagacgagggatttgaacaagtggaacttttgaagaggatctcactgtatccaacacccctgcccccagctcgacacccaccatcctactttctttctctatgaaatggacaactctagggagctcatgtaactggaggttattacactgggcataacattctgaggttcatctgtgttgtaccgtgtgacacaatttccttcctttttaaggctgagtaatattccatagtgtgggtggaccacatttgtttcttcacacattcatccacggacgtttgggtcacagccgcctctgctattgtgaataacactcctatgaacacagtgtgcaaatacctgtgcaggcccctgctttcaggccttggggttgcctccccagaagtggaattgccgcatcatgcaagtatttattttgaaaccatgatagaaggtgattccccctggttctacctttattttcctgctgggcgatgaacagtgtcccgtccaacttccctgttctcagtcaacagacactggtctttgagaaggtcacaggaggcctgggtcctgctgggtaaacattgatgagcttattttccagctcgctcggtgcggtctgaagctgctctgtttgctcttggtttccttcaggcttcttcatttcagctatcgtgacagtgttccaccacattgtttcagtgactctgcgattaactgtttcacagtcagctatggaagggcctctaatccgaggggacacactgcagacaggcctcctcagggctcctgcctgagcctgcagcgttttgtaagctgactcactccactaaaggtcagctctcacagctgtgctgcaggatttgcaggtgaatggggaaggcgtggccagcatcagctccctgtggcttctggcgctcaccctctgcagggcctgtctcactgagaatggcaggtgcccacaggaacatgcacacacgcatatgtacacacacgcacacacggtgcagttccatggggtgcgtgtggagcttgtctggctctcctctccctggcagtgctttcctatcaaaacaccagtgcccgctctgccgtgagtgcgtggtcttgcttttcagtggtgcgtaatgcgttctggctctggtgggccaggtgagagcagaggcctgggaacatgttgttcagcctctttggaaggaccgctatcatcttagaattgagcgtgagagagcaagagggttcgcccacaacttccttgcgcagcagaggtgaggtgcccccggcacaggcgagcacctctagctctagggtggcttgtggggcctcctgttagaaactccatctatccccattggtcagtggtgtctttaaagatgccagtgattttcgtcccagcaaacctttgagcatcacactgttcaggtgctgggcaaagctttgaggataaaagaacaagtggaagacaatccctgacttgggcttagggtgaagaagagcagcgaagaaacagacacatttgccgccttgggtggagtcgcgacattgctgtttctatgtcagaagccttggagcatggatgattccatggctggacctaatacttccatgctttatggtaggagattacacaggattctgaggggggaccttgtctccacctgggggcacgcgggagggttgggaagcacttcgggaaggaccaagacttgccccagccttgagaagtgatggggctgcagcattcagatatgagtctcacagaggggtttgcagaaacaattagctggagctgaaaatgtactttggggaaggggaaaatgaccacaagaaacagatacttggaaggaaattggctttttggctatccacagtgtttctggcatgggtcatagtcgtggcttggtggagaatcctcggtgtttgtggcatggatcgtagtcatggcttggtggagaatcctcggtgtttccagcatgggtcagtcgcggcttggtggagaatggctgaatcctggcaactgtggcctttgcaggggctgtagttgtgcattcgtgaatctgacgggggaagatgtgtttcttcacatcttcaggctccttctgtggttgggtgctagctgttgtatgctgatggactggtttctcttggcccacagaaaatgttctttaataatttggtagactctggacttgaaacttcctggttcttcatgcagttctcaaagctcatgattttcttgggagattcattgctttctccttgcatgccatttagtgttgcagaaaacagctctgagaaaaggcgatctcagcagcacgccgtgttaaagaacagcgcatgttgggagaatgagcacccactgctccctccactcatcttttctttatagttctgagtctcgagtgagacggcctctgaagatgaacatgttgtttgtggaaatggtacttgcagtgtggctgtcaatgattaacttcttgttttcaacctttcctgattcctcagcatctttctacttggactttgtgtattactcaggaagctggcaggaattcctaatttttttaagacatgtgttcagtgcatatgaacctccagacatttgggaacgagttgtgttactggttaatgttggaagcatggctggtatctgctcgtgtccaatgccaagggtgtgggcagcttcccaaggccaggtgagatgctggcatgggggcacaggtgctctgactcaccagggctcctgtgttagggggatggggtggaccaccgccccagcttgcacaggggacctctggtctcccaagcgccctctgattcaagggtgcctaaatggactgttctgaatggaattggctgcagtatttttcatcttttaattaaaatggatgtggcggattacctgaaaccaggagtaactgttctgagctgctggagagactcctcaggtgaacggaaggtgtctgaagacagcaggcagcttctctcccaagagccccttctcagagccagagccgattttgcatgccccagagcacacatgattctgtgggtgttttatcaggaagttaggggtttctgcctgagtgctctacaatatgtgctctatgattaaagtcggatttctcctctgaagaaactgtgtttgacatgacagaatcaaaggcaagcatcactagtcaccagcgtgtcagacacaaacaccaggctcatgttttttgttttgttttggtttttttttgtttttttttgagacagagtctcactctattgtccagggtggagtgcactggcatgatcttgcatcctctgcctcctgggttcacgccattctcctgcctcagcctcccaagtagctgggactacagatgcacgccaccgcaactggctaatttttgtatttttagtagagacggggtttcaccatgttagccaggattgtctcgatctcctgacctcgtgatccgcctgcctcagcctcccaaagcactggtattacaggtgttagccaccgcgccccgcccatgcttatgtttatccatgctgctctcggctttgccgaggggatgatctgggtagggggattcacttggtttgaactgttcccactgcaaagaaattctctccctcctgcttgcctcatccgcttctgggttaagtccaggactggcaaaaacactgcctgttcccgagggagcccctgtaaccaacctctccccagatgtctaatcccttgcttgtgattccagcagaggtctcggcatctcgtccacagtgagctggtgtcctgccagtctcgggaggcactcggcagtgtgagtacatccttcacctctgtgtctacagacccggcctccccgcccagcatgggttgaagccaggctaaggcgttgatcccaaggggctgtctgcaggggtttggggcaggcctgagcattcaccccagcgtcctgtgcaaacgtcttcgtcaggagcgcacttgggaagtcctacactagcgcagagggtgcgcagccagcgggtctatcaacttggatgcaggtagtgctcagtggcatttggaggagagtctaataaccaagaggatgaatctctttgaaggatctgatggaaacaagaaatgaagagggttgttttgttttgtttgttttatgagacagagtcctgctctgttgcccaagctggatggagtgcagtggtgcaatctcagctccttgcggccgccgcctcctgggttccagctattctcctgcctcagcctcccaagtagctgggattacaggcatgcactttgacaccccggctaatttttgtatttttagtagagatggggtttcaccatgttgtccaggctggtctcaagctcttgacctcaagtgatccgcccgccttggcctcccaaagtgctgggattacaggcatgagccactgtgcctggccacgaaatgaagagattttactacctgaaccttaaaactgttcctgagaaatcaccaagaagactgaccagcaaatgaaaacctggaaaaaaattgcaacaaaggatagatatttatctatgcatctgtcttacatagcagagtgaaaaggaggcacacgttcatagaaagtgaatataaagcttgcacagaaataggctgacctgttcagtttaaagaaatgtaatgctgaccacaaggtctctttctctttccatttttatggccaaaaattccaagcctgctggtaggaatgccagtccttatcgatatactggaaaacaactgatgtcagtaaaagtcttcaaatatttttagttttcgtcagcaatgttcacttctaagaatttaaaagaagaaaatgataaaaatattgtcacaaacattcatgaacaaaggtgatcatcacagccgttatttataattatgaacacttgcaggaaagcaaaattacagcagtaagggtttggaaatgatttagttgttgagatcataattctccctggcacatcttacactataataagtgaaattgccagttataaaaacgatacacagtcttcaattttgtaaacaccaaatatgtgcagttttgtaaaagacttaagatatgcacctaaatataaatgtttttaatcatacatgtgccatttgttgttctttttgtttttctgcatgaggaaaccttcttatctatgtcagaataaatgcttcttagaaaaggaaattagactgaaaacaggcacgaggggggctcgggcttcctgccccccggtcccctggtttgccgctgacgctagtggagagctcttctcgccttcaccttcctggtggctgtctcgccgggactgtgccgctggtgacctggggggtgttaattacctaacacttttcaaggggaaaatatttcgtgggagaattcgtctgaaattctgctggaggcaccttggagaaacagctgcgtgtaaatgaagccgcagccaaaacgcaggccagggggcccagcactttcccagaatttggggggtgggggcggggcgggggtggggctgactctctcgcccctgccctgggacctggccgctccccggcgtcagctggtgcatgcatggtgatggagctggtgttgaacccccgcgggtcttcgggagctcgtcctggcggtgggtggcgaatgccaaggccccctcaggagcctaagcccagctttattttccataccatgtcagtgactccagaagacccagaggctgggtctggtcagaggtgatggccagagggagcccgtttgcaatgtcccacggccaggatgggtctggctggcggagccctgtgtctacacacgtagccttgggtcccggggtctgtctgcagctccgcccggcaccgtccatgcagggtgtagacccagacactctcctgcctgggagagcggcccagccgctagtcctgtgcgcccaccaggttcttctctcccagcgtggccgccatgttggccgtgatccccggatcctgcctgctgcaggctcctctgggaatggcccgcccaccatgctcctctgaaaccctccctcacttccagagacctgggccccgggcctcacccaagcccctgctgtggtcacccgggctgcaggcgtcctctcaggtgtctcagccgtgggcccggcacccccttctgtgttcacctccttccccgaggccgagggcgcggcgggcctgcgccagcctttcctcacagaatacccgggacctcacacggatgcgctgagcagcgatttcttccgtcttcctctcttccgacttctttccttctagaaacaaatgtgatctttggttactgggttttccctaaacattactgagctgtgtcatcagaacttagacttcaggtacctcaaggaaaagaggttctgtttagcagcagagaagaaaaaggctacacgcaggctaggtggccaatccgccaagaataggaatgagatgaactttgaattctttttaaaaagaaaaaacaatgtcttcattgagtaagttctaccccaccctcaccaagagtcacgtggctggggaggtggccgtgcatgtggcccaagtcccttgttctgtgaagtttcccatccccgggcccagcagtcacatcctcagagtgtcagttaacatgtgtctctgtcccctgtgtttagtttattcagaacctgaaccagctccaggaggacacctttctcttcaggcaatttcagagtggtgctctccatctcaggagtgggtaatgtctgggtgtgagtgtccggggacattggcagccacaggtcattgttgcttaaatctattaatttattccttttttttttttagatagagcctcgctctgtcacccaggctggagtgcagtggtgcaatctgggctcacttgcaaccactgcctcctgggttcaagcaattctcctgcctcagcctctcaagtagctgggattacaagcgcacgccaccacacccagctaatttttgtatttttagtagagacggggtttcaccatgttggccaggctggtctcgaactcctgacctcaggtgattcacccgccttggcctcccaaagtgctgagattacaggtgtgagtccaccatgcctggccaatttattcttaagagctgcaaatgtcctcattgtgtcatttcttttttatttatttgctggaagtcacctaataaatatccccatatatattttatatccttcttttcttatataaatggcttgtgtctttgtgtggctgtgtgtgtgtcacatgtctgtgtgtgtgtctgtggtgtatctctgtgtgtgtatgtatgtatggggtgtgcctgtgtgtgtgtctgtagtgtatctgtgtctgtatggggtgtgtctgtgtgtgattgtgtgtgtgtctgtggtgtatctctgtgtatgtatggggtgtgtctgtatgattgtgtgtgtctgtggtgtatctgtgtctgtatgtatggggtgtgtctgtgtgattgtgtgtctgtggtgtatctctgtgtctgggtgtgtctgtgattgtgtgtctgtggtgtatctgtgtatatggggtgtgtctgtgtgattgtgtgtgtgtggtctatttctgtgtctgtatgtatgggatgtgtctgattgtgtgtctgtggtgtatttctgtgtctgtatgtatggggtgtgtctgtgtgattgtgtgtgtgtctggtgtatctctgtatgtatggggtgtgtctgtgtgtgattgtgtgtgtgtctggtgtatctctgtgtctgtatgtatggggtgtgtctgtgtgtgattgtgtgtctgtgtttatgtgtgtgtgtctttgtgtgattttttgtgtatatggcaaacccagaacagaacattatcactcacctcacctggcaaaacaaaaagctttcagagagatgtgtggccgtcatgatgtctcagctgcaggcatttttcaaagttatgtttgatgcagctggcacctttcttctcggggacaaatgtgatctttgatcattgagttgagaatgagtttactcaataattttaaaatgcctcggtgtgagaggatgggctgctagtaaacatttgtggcaaatatgcgttgtcttttcctccttcaagtgcatggggcaggctgcttctctgcacgtccatctgtgggtcagtctgtcctgccacctcccttgccccagggcttagtgccctgtgtggatcacggctgccccagggatgctggggaaggattcagcccaacaaatagattcgttgacgtcctctcaacgaatgtgtgcttttaaaaatgtctttaattttgcactccatttcatacaacaggtgcacatttaaaacatttatttttaaacagctctgtcttctcagcactgcagactctttctcgctcacttgacaggcagacgttgggactatgttcttttcctgccaagaatccatcagccccccaatgcctgcacctcgagtccagactccttagcgttgcgttgggacgtaattccccgttagcatccccagccccttctccccctgtgagccagcctgggttcttttctttttcctttcttccctgttttccttctttcttttttgggtttgtaataagtaatatacagtcttgtggttaagaaatcaaaataataaagaagatacggcttgaggattcttgctctgcactggtccttccgccaggacctggtgcgtcccccaagagggccttgccatgtgcgagctgagacacatgttcacactttcctccttttttgtacaaaaggtagcacatggtaaatagcgtctgcacgcttctcccctcgctctgtcttcgggactactccacatccatgaagaagcagcatccttattctcttgcacagtgggcagtggctacactgtattcactcgtctctgctgatgggcactactgtagtggtgcaattagtaacctagtatacatgcccttcagcgtgtgtactggtgtatggatctcacattcccagaggctgagtgaaagaataaaggctttttgacagtattcctcaggtactcacacactcgctctgtgagccacgtgatcatgggagcggctccctgcagaggtgtctgatgggagaggctgatgtccttgtctgatggttgctccaacctgagaatggtgagctgctctcccaatgcagactttcatcacttgcatctcatgcgtgagattgaactgcttctcatttatgtttttatctttgtttgcccatattttagctgggttgctaatcttttaatgttttctaggcgcttttcataaattagggagtttagctgtagtgatgtgagttgaaagtattttttcaaatcgtcattgtcttgactttcctttttttttttcttttgccacttaaaatatgtagttgaatctcagtatttgggggcttctggattttgagtcgtagttgaaaaggtcttcctattctgaggttatacaggaattcacccatttttttcctaatattttatttccatttaaacttttgacccacttggattgattttgttgtatggtgtcaagtatgggtccaagtttgcttttctgacctggggatcctaacatcgttcatcaaaatctccatgttggccgggcgtggtggctcaagcctgtaatcccagcactttgggaggctgaggtcggtggatcacaaggtcaggagatcgagaccaccctggctaacacggtgaaatcctatctctactaaaaatacaacaaattagccgggtgtggtggcaggcacctgtagtcccagctactcaggaggctgaggcaggagaatcgcttgaacccgggaagcggaggttgcagtgagctgagattgcgccactgcactccagcttgggtgacagagcaagactctgtctcacaaaaaaaaaaaaaaatccatcctcactacacgcatcagcagttgccaccattaaaatagattgaattttcatacatatttgagtctgtttctggactccctgttctgtctcatttctgcttgccttccattttcccacacccactactttaattactagggctggtggtctcgtttcactgctgtccttggtaagagcttcctggacactcttgctagtgtaccttttcctaggaaccaaagttcctgttatctaattacatgattgcatgaacaaatctgcagataatcatggttttctttcttgtcaatttttgtgcttcccatctcgtcccgagtggattgcccagcatctcctggacgtgattaagtagtagtagtgatgttcaggtttggtgatgctgccttctgtaatatccctattcaatattatactggccttcaggctgagatgggtactttgttgttgttgttgttgttgttttaattttttaaaaattaaaaacaggccgggcgcagtggctcacgcctgtaatcccagcactttgggaggccgaggcatgtggatcacaaggtcaggagatcgagaccatcctggttaacacggtgaaaccccgtctctactaaaaatacaaaaaaaaaaaaaaaattagccgggcatgatggcggttgtctgtagtctcagctactcaggaggctgaggcaggagaatggcgtgaacctgggaggcggaggttgcagtgagctgagattgcgccactatactctagcctggggacagggcctctgattccgaggcgacttttcccctttcatttcctattttaagtatttgtcccttctctctttttccttgattaggttagcggatagtttatctatttattgcttttgttcccagaagccattttcaaaatgtagttctactgattttccaatttctgattcactgatttgtgcttttgcctctacttcttgtccttttctttagaaaatcttctgagctcctgcttgactcactggtgtttcatcagtctttggggaggtggtgggatgagtctccgcacgtccgcgctctcgcgtgcctcacctgtgaggtcctctcccttctcacccagcgtcacgccctgacccctcggctcccgtgtcctctgacttccttgcaccagcaccctgttgagctccacccctgcactggggtctgtataggtggctgtcatgtgtgccgagcatagctcagtatagctgcatgaagcgttccaccgggcagacggtgttgatcctccagtctctgagccacagtggtcctccgagtggtccttagagtggtcctcagggccactccccgaacaaccagctcacgccttgcttctcccctcgcccccaaggcctcttccccatcctcacttctaatgggtggactggattcctgcttgacagagctgaaccagttggaagagcatccctgcctgtcccctgcctgtccctgaacctctgctctgcaccacatccctgccttcctgccggacctctgagggtcctgcacgctctccccacactggtctgtgtccccatccctcttcccactccagggcagtcatcctccctcatcgccaagtctgagttctccccggattcctgtcaactcaaaggtgctgtcgtttctcctgtctaaacctgcctgatctctccatctgtactcagcccctcggcgatctcagtcccctggcttgtgacccacctgagtgtgatgattcctagtccacagctccagtccggacccctcccccgggcactgcaccgccctgcctccgcagagcctccacccgcatcctacaggtctcccagagccgcgtcatccactgcagctccatccaccatagttcactgcacctctccgtccagttcctttggccagaaaccccatcgtcctcatctgtgttttcactcatgcccgtatccgacctcccgggaaatcctgttggctgtgcctccagaacagatccagaatccagccaggctaccgccctgtctcccactttgaggtcgcgctgcctctgcgcctgtccctccccaccgccgtctcgcagaacagcaagcggtgacctctcgaaggtgagtgcgggcccttctctgctgaaatcctcagttcagcagggtaaacacagccccctccggtggcccacctggcccttcgtgccttccttcctccctctgggtgggaccctctcctgagagacctccacagtcggccgcagttccccctgatgttctttcaggccctccttggtgtcttcctgttcagctctgacctggaggtacttccactggatgggtagtttgtgtgtttgtaggtttcatttcatgtgattttcccttctcttgtttgctgcgggggttctccttactaaggttgaagacttacaagaaagctggcttctagaccctctggactctgacctagcctcacctgcccacccccctgctccaggccggcttgcgtccccaggtgaactcagtcctttcaggacaccttcagggctgagcccacagtccagtaccatttcctggtctgtttgaagtcccctgggactttgtatctttccagataacttgccactttttctaaccagtggcataattatttgaggatttgtcttcacctagttgggtgttaacctcttgaaggcaggacctgtctctgagtcattgtgctgccttcataattcctagcaatcgcaaattaagggaacgcactgtgtccgggaaggcatctgcgcgggaggaactgaagctcctgagcgcatgttagggatgaggagggtccctggaaacagtgctgacagccccattgaggggagaactgttactaccctaacactggggatggggatcacaggaacgtcacgagaacgtcattttgggaagccagcttggtggaagctccgtgttggggaactccagtagactgggagagagagcaggagtaactgacgcagttcacttccccgtggggtttcccacacctcggcaagttgagggtgtgcaggcccttgtccttgttgggttgcatatggagagaatgtccatggggagagagtagggaggggaccacaccctggaaaggccagtttgaaaaacctaggcctggggggatgcagcctgggggatgcaggggcgtggggtggctccaaagtcagctgccttggaagattccagtgatgaacaggggcagagctggtgtctgtcactcagctggctggcatttcctgcttttgtctcctgggaggtgctgtggatataaacattatatgcagagcagcagtgctttctggttagggatgcagcattttaattcactgagcaaaagtggactggagagtcgttttggtaagagacctgactgaagcatcggcccagactttcacgagcggggtcccattttcccagtgcaggagctgaggcccatctggattacacggattcttgaagtgccccatcctccgtgtccccacctgtgggctctgcccctgcgcttccccgacgcgcgcccccttccactgcacttgctggcagaggcgctgttgaaaggctctcagacctctatgctgacacctgtggtctgtgggccccgtgcctctcttactattccttcattctctttccttgtgcctagcaacaatttcattaattcaaattcatttacaagatataaaaccacacaatataacttttagtttttaggcattttttcaattatatattctaacaaaagactatcaggtaagaatttgcattttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatgctctcgatctcctgacctcgtgatccgcccgcctcggcctcccaaagtgctgggattacaggcgtgagccaccgcgcccggccagaatttgcaatttttataatatttaaatgaaatttttctttcaaaactgttaggaatcactgttttgttttaaaaaaaaatgcctagaaacgccttgagaaaatagaaagcacataaagcctgcaaattctgagagtaattgttattaagtgggtgtttttcccaagagtttgtatttgtagtcttttcttagctagtttaacatttgttcttcatacctactagacagatttttttagttacactcttgataacagtattcattcattttatcagtaccatctgtaactccaaaatgcaatttttaaaattaaactaagtagaccatgaaatgtatttgagatgcaatatcaaatttttcatgctttgaaggaccccaaaaccagtgtaatttctcttccctcaaatatcaaggcatggctgaattatggatgtttcagatgtctctttccttcttttcttatggtagcgaggcacccctcctccatgaaatcagtgttttcctgcatttggagtgactgttaggtttcctttatctcaagctgtgctgtccctcccacagtttggagtttttctgggtctcaagttagaatcaggaaggttaccatgctacctggacagttaggtgtctaagggagagaatctggcagacaagcccgtgttacctggctgaactgcagagtgaagagctcacgtatgggtacatggcggagaggtgggaggaggcgtgtgtctgtagagtacagttctgttgttctctaacagaaaacatagagtttttgttgtttgtagttggtgcaaaatgcagaagaaaactctgcattcaaaatcagctatgaagagtgatgtctgtgtgttgctgctggcttgtgtgtgtgtgtgcacacgcgtgtttgtgatcagttatctgatattcatggggcacattgtacctgttgagctgagctgagttcctgagatttggttaaatgcagaaagactagaatttaccatctgttgaaactagatgcctgtggatggccggtgaccccagaacgcaggacaggatggcaagtagcctgcacattgtatggcctgctgccctgcggttaccgggctgctctgaagctggaggggagcagttagtcaacagtaatccagtcaggttgtgggtgggtgccagggggagggcttgcagggagagttgggttgtgggtgggtgctggtggtgggtgggcggggggcttgcagggaggacccgaccgagctcttccaggtggacaggattcagaaggtggagaggaggaagagccccacaggctgagggcacagattggctcacaaagagcagtgcagccactcactctgcacaagagacactcctgaaagaaacacagccatggccaggcgcggtggctcaagcctatagtcccagcactttaggaggccgaggcaggcggatcacgaggtcaggagattgagaccatcctggctaacatggtgaaacctcatctctactaaaaaaaaaaaaaaatccaaaaaattagccgggtgtggtggcgggcgcctgtagtcccagctactcgggaggctgagtcaggagaatggcgtgaatccgggaggcagagcttgcagtgagccgagattgcaccactgcactctagcctgagcgacagagcaagactccgtctcaaaaacaaaaaacaaaacaaaacagaacaaaaaacagaaaacaaaacaaaaaaactgccagaagaagttaaaatagaaggacgaatagggcaggctggtcaaaccaagtaagaaaacagaggttgcaagtttgatgcctaacaacgcagaattcagagcaaaagccttgaaggataaagacgcctccattgataaagtctgagatttgcagggaggctccacacactgtttacctgtcagcatccaggagtgcagcaataactttagtaaatcagagtctataggatttgtgtggaaaacaatcaggaaccaaacgacctcccacctcctagtctaagatagatcaaagaaaattctgtcaagacacagaaaccctgagggaagtcccatagagtcggtcaacctgcgaacactgctgcaaaataaaccttcctgttagatacacgagacacaatttctagaaaactgattgtattttggacgacagagacaccctcaaattcccagggatatgaataatacaggaacactgtcctagacgttaagaataaaatcagaaggctggaaaagaaacaaaacaaaaatgccgctaagcagcctttgagttggaggccatgccagctaaagtggagagttcctaaaagtacaacacacaacttagcaaatctatgaaatatggcaggagagagtgtcaggaggattatatcaatacttatatcagtaaaaatgtaaaaaggatgcaaatacctacataaaaatggtagaaaaagaacaataaaacaagccacaaaaagtagataaaagcagaaaataaggatagaaataataaaaataataaatctaaaagctgttttgaaagagacacatgaggccccagctcacagtgaatggaggaaaagtccagaggcccagagctggaaacgtgtgggccgggagcagcccctgccagagggcactttatatagtagtcgactttgtacaaccaaaactcaataaatttgaaagcgtagaagaaacagatagtttttcagaaaattacagctttccaaatttgatactgatagagccaaagtctagaataaatggggaaaggaaagagctcttccccgaaagagcaagccagattattccacacagaacgtcttccagatctctaaagatcatacaatttcagtgcaacttaaactgctttgtgaggttttctttttctgtcctttaatgtcactttatgtagtgatttcaacattgatccccaaacctggcaacatagtactttggcagaaataaactatggactgatctcaatctcatttctcagcattgaagtaaaaatctgaaagcattcacaacacataaaaaaaaaaaaaacccatcagccaggcgcagtggctcacgcctgtaatcctagcactttgggagaccgaggcgggcagattgcctgagctcaggagttcaagaccagcctgggctaaacggtgaaaccctgtctctactaaaacacagaagaaattagccaggcgtggtggcacgtgcctgtagtcccaactacttgggaggctgaggcaggagaattgcttgaacctgggaggcggaggttgcagtgagctgagatcgtgccactgcactccagcgtgggcgacagagcaagactccatctctacaaacaaacaaacaaaaaccatcgtgacaattaggggtttattcaaggaatgcaaagatggttaacattagaatccattaatgcatagagagaaatcatgtaagtttcatagatgtggaaaaagcactcgacaaatgcggtgcctctttatgttaaaagaaatccagtcataggaattggtggatacttttttctgtaacctttattttaacaatttcagatgtacagaacaatggcaagggtagcacaaagaattctcgtatataagacactcagattcctcaatattatgtttcaccatgtttgctttcttctctcatgtgtgcatattacacaaatatacattattattttctaggtgtcagagagtacgtgacagacaggctacccttttatctccatgaacttcagtgtttgcttcttttttttttttttttttttttttgagacggagtcttgctctgtcacccaggctggagtacagtggcaagatctcggctcactgcaagctccgcctcctgggttgacgccattctcctgcctcagcctcccgagtagctgggactacaggcgcccgccaccacgcctggctaatttttttgtatttttaatagagatggggtttcaccgtgttagccaggatggtctcaatctcctgacctggtgatctacctgcctcggcctcccaaagtgctgggattacaggtgtgagccaccgcacctggccagtgtttacttcttaacaaatatatttgtttgcttataaaactagagtataattctccaaattgtttgttttttgccattactttgaatggcaaaacccacaattacctttgcagcaacctaataggtaattaacttcaacacactcttctctaatcactgctgttttgtatgtagatccagagtctatgagttgtccccctaaatgtcctttaaagcaaaagaaaattcaggagcatgagaatttggagcaggagctgcattcagttgtcctgtgttttatctttctttactctggagcagccccttagtatttctttgtttcatgacaccgccactttggagagggcaggccagttatgttgtagaacattcctaaattggggtttgtctaatgtttattgctaaatccaggagatgcatttttggcccagaaatgctgatgtgtccttcccagagcgtcctatcaggaagcatacgagaccggtttatcccgttactggtggtgttaaatttgacgacatggttaagaagggagagcttctgtaacatgacctaaaaatacgcacacacattatccccaaagccagcatcctactcagcaggaaatgctggaagctctcccactgaagccaagaacagagtgaagctccccacaacccccccacgatgtgtcgtcgttagagtgcccccacacgcagctgggctacagagacagcacagacacgggagtttaccttttccttttcattatctctattttcaatttctccgtatgcagttgttacatttctggaaaacccaaaataatcattggataaaatgctacaaaaaaataagggaattaataaattttataccctgctgcttaacatgtagaaatcataggtaggaacaaaaaccaaggagaagatctaatgggagagataatatttatagtagcaaaaataaagtacctctgtttttagcattctcgtttaataaatgctgatacgaggaaaactataaaatactcctgagacacagaagacttgaacacatggaaaaggtatatgatagctttagatagggaagctccacatgacaaagacatcagttctccctgaattaatgcatacacttaaggagccccaataaacacatcatctttttctttctcagggtgctagacaagttgatcataaaacccacttagagaaacaaacatgaacacctgagaaaaccctggagagtatcagaggggaatgggctgcccagacgttaaaattttctatacagcctctttaatgaaaatggtgtggatcctggcataagaacaaggacaggtgaatggaacagaataaaaatccagaagcaaatcaggctgcctggggaagatccatgtagctcaaggcagcatgtaaatttcgtgctggaaaagatgaccttggttatcaatggtgttgggataactggatagcctcatggaaaaagatgaaagtcaggtcttcttcacacctttcacctggataagtaccagatggacctgtgatttaaatgtaaaaagtaatccaataggcatatccaataagcatatgagaatgtggttggcatcatgattcaagggcaaaatgtacattaaaaccacaatagggtaccattcttcgtccaccagagtggctaaaattaaagactggctattccaagtggttggtgcagaagtgggataccagtgctcacatttcctggtgggaaggcatattgctatgaccactttggaaaacatggacagggtctaaagctaagcatgtgcctgccctccgattccaccctaactgtgcacccaaaaggaaggagtacttctgtacgtgtacgtatgtggacgttcacagcagcttgatgcccaggagccccacgctggacaccctaacctctaggagccttaagagaaaacgggttaaataaagggcatcatattcataccccacaaagctacacgagaagaaataaaccactacaacatgcctgcagttcacacatcaatctcaagatcaggcaaaactagcttctctggtagtggtcatagtattaatggctgctacctcttgggaaatattggttgggaaggggccaggaagcctcctggggtactagaaatgttctttagctgacctgggcagtggtcactgggtacatacatacgtttgatgtgataaactgctccgtgcatgttcctatatctagtaaaggaatcttaacataaagcaaaaccacacaagaaagcattgcgttgattacattaaacgtattttaaactttgcatgagaagaaaacaagaagcaaagtgaaaagtcctgtgacagactggaaaaaatattggcaattatcaaaatgaaaggttgctatttaatatatggtttctaaagtaaagaatagcataatttttatccctatagaaaaaaaaatctagagatatcaaccagtagttcacagaaaaagaaatccatcacagtagccaagatatgggatcggtcacagatgaggggataaacagaacatggtccgtatccacagcagagggctgtacagcctggtctgtttgcacagcggagtgcggtacggcctgctctatatacacagcggagtgcagtatggcctggtctatatgcacagtggagtactgtacggcctaatctatatacacagcggagtgcactatggcctggtctatatacacagcggagtgctgcatggcctggtctacgtacacagcggagtgcagtacggcctggtctacatacacaacggagtgctgcacggcctggtctacatacacagtggagtgcagtacggcctggtctacatatacagcggagtgcagtacggcctggtttctatacacagcggagtactgtacggcctggtctatatacacagcggagtgctgcacggcctggtctacatgcacagcggagtactgtacggcctggtctacatgcacaggggggtgctgtgccacctggtcgatatgcacagcagagtgctgtgtggcttcatctatatacacacagtggagtgctgtatagccttggaaaaggatgaaaccgtatcatttgtgacaacatatatgaacccaaaggacattctgttaagtgaaataagccaggcacaaaaagacaaatcctgcatgttctcacttacatgtgtactcgcagaaaggggaactcataggagcagagtggcggtcgcctggggcagggggcggggtgggatgtgctgggaagatgttggtcagggattattgtacagtatggtgactataatgaatttctgaaattgctaagagtagatttaagtgttcccaccactaagaaataagcatatgagttaagacatgtgctaattagctcgatttagcctttccactgtgcatacatacttcagaccatcatgtagtgtgctataaatacagtttttgtcaatttaaaagaaaaaagatgctaaatcacacttacagagaaatatgaattaaaagcacactggcatactgcctcttgctaatcagaagtttagctggagaagtggggagggctgaactctcccgtggcatggctgcggcaaatggcatgacctcatcatgtgaacttggcagtatctagcgaggtcatagacacgtttgccctttgaccagcaattccacttctaggaatctgtcccaaaagtactctggcagaaatagagttatttgcaattttttaatagtcttctagtcttgatgttgaactggaagcatctgtataagtccagtgtcttttatcgtaaaatacatggtttctagacctgtccatggaaaaaactgaacacagagagcccagttgtggtctcctcatgtcattcccactgagaagatctggaggtctttggataaatgaccgggtctggggaaaaatgtttccaacgagcctacaacatcttgttctaccagcaagtgcaagactaaaaggtaatgaatgactctttataaaacatcaacacaatacagtcaattccacagcctctgatcaggaagctgctggcatcacagaaggcgagttggacattagcacctcccttggtgaactgctcttgccaaaaaagtaaaagtaaaagctgaaccagaatctgaccaggcacctagatgtaactgtcaatttataggaaataccggggacagaggcacatgataaacacctccaagggggcgtaatcgacaaaacccacctcatgtgaagctctacatgacaaatgacctggtttctccaacaacaacaacaaaaatacaaagaaaagagaatcagcaagaaaacctgtctatcaaaagagactcaggaaatagcagccaattgcaggctatggactggataagattttgatcctagttcaaacaaaatgtgtctagaaaacacagagaaaaataacaggagaaacgttaacactggctagatatttaattctgaataattattaattgtattgtggctgtggaattgattgtattgtgtttatgtgtataaaaagtcattaccttttaggaatgtttactgaactctgcacgtgttaacagttctgtgctgtctggggtttgccttggattgatggtggtgggcagccgttgctggggatgcgggtgaaacgcggccggccgtgcaccaacgttgttgcagtcattgcaccgtttctgatgtttttgcactcgtttgaaatttctatgatttaaagaaaactttttataatgtaagttgcatggcagacactgccctacctgcttgattcctcagtcttctaagcactgctgtggtcttttttcctcacagtcataattaattctctgcgtgaatgtgcctcgttataatccttggaaatgtgcacagagcctatttctgtctagccatgccagccgttactgtacttgcaaagatgctatctaaatggaaaggaactatgtccatatctttcaaataaatatggtgcttttttcctcccttcacccccaaaaaagtcatgatgactgtctactcctagtatttgttttataggagcattggcatcgctagtgtctgtgaatagctggagtgtgcactctgaaactttactttgcctgttgtatgggacacacacaggactaagagacacatgtaaaacgcatgtggtcttggcacggggaaaggaccatatgttttttaaaaacagtctccagcagctctgacgcttccctgcaggggagagggatgtgcgtgctcctcagaccctccttgagaggacttcccggccgagggccttttctggccacatacatggatggaggtctgcgcctcctcccagctgacagtctgtggcatctgcagtggggctgtctgtggctggcacctgtggacacagaaccaggagacacaagccagcctttactggagcatgttagagccaggacgtgcctctcacctgagctactcagcgtgcagatgacaaacagaggttcagagtcctcctggctgtgtcttctggggcctcccagcggggagggagtggcactcggtgtttccacatccctttctcctgcctgcacagggagctccagctgttggctcattttgccttttcctgccatggagaaatcagggacttacctgatcagttttatattggttccataaatggccactgggtctccctcttcaaaggggtgtttgctctttattcctggattcgtggttgtccttaatgtgaatctctttccccgattcctgcgcggctgcagcaacgctgcggtttgttcaacttcgtggctgcaggacgctgtcagcagtttggtcttcttggcacactgccacttataggccaggaaatgggataaagccatttatcttttatcgggatgggagcctgccctttccgccttctcttaaatgcattagtaaaaccacttgggaaaaacaacagggagttcatttgaaactcatttccaggttaactcttcacactcctgatgaaatctgtgaagtgcatggagtctgcccctgccctcaggcccctccacagcaggtgtcagaatcaccaggtgggtggagctccagaccctggccccttaccgctggccacagcatcctgagcaccctgcccagaacctccggcctcgggttcctcttctgcagaaagcagatgatgacgcctgcatcacggactgcatggtcgggatggcggagtgaccacaggctcgggaagtgacttgggacggtcactgtggctgagttagcagttggctgcttgttgttttcttccgtttgtggcgatcctttctttcccagatgacccctgttttgtgacgttcattcttcccatttgtcattgaaagccgttgctgggataacgctctaataaaaaccagtgccagaaaagatgctcagaatcatttgtcattagagagttacatatgcccctacacacctgttagagcatcggcttccacaaaacctcacaacgcctggtactggcgaggacacagggcatggggagctctcgttcactgggatggagcggagggagtggggaagacagtatggccgttacttccaaagctaaatgcactcttaccatacagtccagtgatcttgcttcttggtgtttacccaaactagttgaaaacatgtccatacaaaaacctgcacataagtgtttataggagctttattcacaagcactaaaacctggaagcaaccagtatgtcattcagtagatgaataaacaaactgtggtccatgcagatgatggaatattactcagcagtgaaaagaaatgggctaagtcatgaagagacatagaggaaacttagatgcttattgccaagaggaagaagccaatctgaaaaggccacagactgtatgattccaactctgtgatattctggaaaaggcaaaactatggagacagtgacaaaatccatagttgctgagaggagagaggggtgagtaggtggagctctggggattttagggcagtgaaactactgtatatgatatcatgtatttgtcaaaacccatacagatgcacagcacagagtaaatcttaatacctgcaaatttaaaaattatttaggacatgcctataatcccagcactgtgggaggctgaggagggcagatcacttgaggtcaggagttcgagaccagcctggccaacatggtgaagccccatctctactaaaaatacaaaaattagccaggcatggtggagcgtgcctgtaatcccagctactcaggaggctgaggcaagagaattgcttgaacccaggaggcaggggttggagtgagccaagatcacgccattgcactccagcctgggtgacagagtgagactccgtctcaaataaataaataaatagtaaaaatcatttcggaggtcagaggggtccccggaaggaatgcaggaaccaggagacacaagccagctttactggagcgtgttagagccaggacgcgcctctcacctgagcggttcagcgtgcagatgacaaacagaggttcagagtcctggctgtgtcttctggggcctcccagtggggagggagtggcactctgtgtttccacatccctttctcctgcctgcacaggaggcagagagccaacctgtgctgaagatgcatgaaaccgcctcacggaagaagaggaacagggtgctgacctgcgtgactctgggcaggagtggggtctgtgagactagaggcaaaagaagccacacaaacgccccaggctccacttaattacgtcgtttcccgtagatacaggtcggcagtgctgacgctgctctgccggaagctgaaactgagcgattaggtgagcagctgtctgcggatgggagctgctttctcactgttccaggagaggctacacccgtgttgtaacagagcaggtgtgcggcgtcagtgtgaactgacgcttagcttagtgcagatacaggtggcgacatacagaaatactgtgcacatcccatagcacacgcctgcctctcctcaccttgacagctgagagggcctggaagcagcagcagccagtgtccacgagcgtccccagtggccagatcttggtttctaattccattcttcagtaaaagcaactgggcttcttagagaaaccgcagattccaggatggaggcaggaagtatgcaagatgagactggatcatcttacagtgacagaaagggaggaacaaaacaaacaaaacaaaacccaaacccacgtggatgggggcaggccagagggacgcaggaaccaccgaacactccccatgaccaaagcagaacaatttgagcagcaaagtcaagtcgcgttgtattataaccccaagaacaagatgaagaagcgtgggtccacactgacgtaaatgattgaatagatattaatacatgactggagacaagagataagtctcccttgcagaagaattccccatccttcatgtagatgagttgttgtcacgaggggagctcagaaccctacttcctgagtgtgggatgtgcgcagctatgtggttccgaagagttcaagacgaaaagagggagaaagagtaacttcccagcagaggacctgacgacctgagccaggcaatcgaggtcagcaccgatggcgaccaggcgtgtagactcgtgccctgggtaaggcgtgaccgggatggcactttacctctgtagtcctcctccccaagcacatcctccccactccaatcatgagaaggacgtcagagttccaacagaggcttccagtatacctgaccagtagccctcaaaactgtcaaagtcatcaaaaataagggagctctgagaagctgtcacagccaagaggagctgaaggagacaggatgactgaatcctagaacagaagaatatattaggcaaaaactgtggaaacctgaataaactgtgcatagttaataataatgtaccaatattggctcattaattgcaacaaaggcaccataagcttaagatatgaatattggaggacactgggggaggggtgtgtgggagccctgttctatgtcagttttgctgtaaatctaaagctgttctaaacaaagctaaacaaagttacttaaaaaagaagcatctcagtaccgtcagtgggcctgtgtggcccctcataggtatctgtattttagcaaaagagaaataaacgactttggctgggtgcggtggctggcacctgtaatcccagcactttgggaggtcaacgcgggtggatcatctgaggtcaggagttgaagaccagcctggccaacatggtgaaaccccgtctctactaaaaatacaaaaattagcctggtgtggtgacacacacctgtaatcccagctacccaggaggctgagacaggagaattgcttgaacgcaggaggtggagattttagtgaggcaagattgtgccactgccccccaacctgggtgacagagcaaggctccatctcaaaataaataaataaataaataaataaacatgaaggaaggaaggagaaaagaaagaaacgaacttaaccacaagctgaggagcaggagtgctgggccgacagccttctgggagacccacagcctcctggaggtccgggcgctggccccgcaggggttggctccagttgtgtgtctgatccaatgggactttcagagacgcccaggctgccgtctccttgggctctgtgtgcagagaggtctgtgtggttggaatttcggaggttcctctgccagttgttcctcccaccaggagctccgtggaagctgtgctccaggaatactgaggtgtgttctgtcaccagccctgcatctgctctcccagccctggctctagcaagaggcttgatggccccgtgggtcaggaccaaccaggtccagcctcgtgctgcccgccttccaaacctgagtgctgggaccgtgcgctgatggaggagaacaggagaggccccaggacagccctggccctgctgcagattcagaaagtgggggattgggtctgggatttcggtatttttcttttagtctgtgagcaggtgtttttattatttcagcacaaatatttctagtagtgcacaaagatggaatatgttgatgttaactcttcatcctcatgacaaccctgtgaggtgtgcccgagtcttattaacccatttcatagcagaaatcatgacgcagctggcccttggccatcggtcagcgaagagcaggcaggagaacccaaggctgtgtccctgacggctctgccctgcagcccctgtggcaggccgaggatacatttcttaacagatgcctgcaggaggaaaggccgctcagctggcatggcctgggcttctgttgggcagtctgtgtccagtgctgatgccatctgcaggtactgacctcctcctgagctctgcccactagtaaatagaaatcaaaattctcattttgctcatttcataaaacttcatccagccttttgcccattcatttatttgctcactgggttcctggctttaaaggtataaggaaaccatgttttaaccctatttcccaccaggggccaggatctggccattcacttgtgcatccacctccctggcagggaccctggcggcagatgcatggaagccccctgcttgccacaggaatgtgactgtcaccatatgcagcatgcccctgagggccccagcagcctgcagggcacacgtccttcccactgtagcaacaggaagcatggtccacagcggggaggctcagcgctgtctctagagggacctgccctgagccaggcatgtggtctgcacatctttatccagtgcctgtcacgggattgccacggggccagagaaggggccagcagggtgagctagaacagtgccttaaactgcactgtgcctcaggaccctcaaggcttgtgcaactcagacccctgggccccacatccagagtctctgattcaagaggtctgatgtgggctccaagagtgtgcagatttccaggggatgctgctgctgctgctgctgctgctggtctggagaccccactttgagaaccactggttgggacctcaagtctgtctctggctgtgctgcccgttctcagccgcccagttgcaggcagatgctgtcactgtgacttggggtaagaggtcacgtgtgctggggctgtgtgccggggcggcccttccacaggcaggtggaaggttggaggccactgagcactgcctggcactgctggcctcctggagatgttcagacaccccacattacaaataggccagcctttcccctgggcgcccccgccactccctgcaatgcttgggccagagacactaatggagtcattcgaggcttgactttgcttcctggtcctggacacgttagtgttcatgttccccaacaaataaatactttagaaaatgtgataagatcacattacaagattgaaatccagcaaggtggttgaattgtgtccccttaaaatttgtatgttgaagccctaaaccccagtacctcaaactgtgttaggggcactgccaatgtatgtaatcacagatggccctcaacttacagtggttggatttaattttttgacattatgatggttcaaaagcaatgtacattcactagaaaccatacctcacatacccatacggccattctgctttgcactttcagtacagtattcaataaattacatgagatattccatactttttttttgagatggagtctcgctcttgtcacccaggctgaagtgcggtggcacgatctcagctcactgcagcctccgcctcccgggttccagcgattctcctgcctcagcctcctgggtagctgggattacaggcacgtgtcaccatgcctggctaattttgtatttttagtagagatgggatttcaccatgttggccaggctggtctcgaactcctgacctcaggtgatccacctgtctcggcctcccaaaatgctgggaatacaggcgtgagccaccacacccgaccccatacttcattttaaggtaggctttctgtgagatgattttgcccaaccgtagcctcacgtgagtgttctgagtgagttgagatagctgggctgagctgtgatgtttggtaggtcgagtgtattcagtgcattttctacttatgatactttcagcgtacactgggtttatcggacataaccccatcatacattgaggagaatctgtagttaagatgaagtcatgcaggagtgggggttgcctaggccaatatgactagtatccttatagaaagaggaaatctggacacagacacagggaaaaggccgtgtgatgatggaggccaagatggggttgatgcggccacaagcaaaggagcaccagggatcaggagcagctagcagaagctgggagaggcctggaaccgatccttccctcgcagcctcagaaggacccagcccttggctgggcatgttggctcttgcctgtaatcccagcacattgggaggccgaggtgggtggatcacctgaggtcaggagttcaagaccagcctggccaacatagtgaaaccccgtctctactaaaaatacaaaaattagctgggtacaggggcatgcacctgtaattccagctacttgagaggctgaggcaggagaatcacttgaacccgggaggcagaggtttcagtgagccaagatcgtgccactgcactccagcctgggcaacagagtgagactctgtctcaaaaaaaaaaaaaaaaaaaaaaaagacccagtcctgccaacaccttgaccttggacttccagcctccagagcagacagaataaatttactatatttttatgccacccaatctatggtgctttggttctgcagcccaggaagtaaacacagttttcctaatcaccctctgccgtctaatgcagttaatgagctttgggtgaaaggctttgatctaatgctggttatttgggaaaaggtgtttttggggaagaagagaaggaggtgacaaggggtgtgatttattcactggcagcagaaaattcagggatgtcttagcaagtttatttacctagaactgctggtaaaagatctttccctaatctggaaataatctgaaatgttttacagtatgctcccaaacatttataattcagattatattaggaaattgtttcctaggacatgtcttttcataacaatggagtgtagataccatcatctctctgatgtaaaatggtatagaatttgcatataacctacgtgcattccctcgtagactttaaatcagctccaggttccttataatacctaatacaatgtaaatgccgtgaaatagtttttacactgtattgtttgagacataatcatgagaaaaagtctgtctatgctcagtacagatgcaacagaatatttcaatgtgcagtatattgaatctacagatccaaacctcacagatatgactgttctcagtcactgtaaagtacaataattttacttaaaatgattacatattttatttttttatttatttttgagatagagtctcgctttgtcccccaggctggagtacagtggctcgatcatggctcactgcaacctctgcctcctgggctcaagctgttctcctgcctcagcctcccgagtagctgcgattataggcacctgccaccacgcccagctaattttttgtatttttagtagagatgggttttcaccatattggccaggctgatctcgaactcctaacctcaagtgatctgcccacctcagcctcccaaagtgctgggatgattacatatattttttaaactccaggtttgaaattatagtatggtggacgttatcttcatttcagaaaaaatttagaacattttcttaatatattgtttataagccttaggtaaagctgatggtaaattattttatgaacaaaagttctttgaaaaggagtttggaggaaagagactttattccagtgaacagtttacaaacctggaagctgcagcctttggtgtgaaagaaagtatattccagagaactcagggagggtttgggttttatagtgatgggtcctgcccaggtcccattcaggtcaatttatgcacatgaaggattcaaatttggttagttctgattggttgatacagctaagccctgattgggtgatgcagctgagccctgattagccaaggtaggtgagcactgatgtgctggttcaggtgagctctgaggggttggttcaggtgagcactgataagttggttcaggtgtgctctgagtggttggttcaggtgagctctgaggtgttggttcaggtgaactgtgattggttggttcaggtgagttctgatgtgctggttcaggtgagctctgattggttggttcattcaggtgatctctgagtggttggtttattcaggtgatctctgagtggttggttcaggtgagcgctaattggttggttcaagtgagtgctgatggattggttcaggtgagccctgatgggctggttcaggtaagcgctgagtggctggttcaggtgagctttgattggttgattggttcaggtgagcgctgaggggttggttcaggtgagcgctgaggggttggttcaggtgagcgctgaggggttggttcaggtgagcgctgaggggttggttcaggtgagcgctgaggggttggttcaggtgagcgctgaggggttggttcaggtgagcgctgatgggttggttcaggtgagcgctgatgggttggttcaggtgagctctgagtggttgattcaggtgagctctgagtggttggttcaggtgagccctgaaagtccagaagttgactggaggtgcgagttctgggggctcaaggcatgtggcttattgtcagtaagtggcctcttggggctgttttaaacataggcccagttgggcactccgggtgggctctttcgggtccacatttgttcacaatttgtttcattgtgaaatgaaggaattgcaggaatatgactgcggcagcattgacggcagatttgggacctgaaactggggtgttaagagaagacgctttttcttttgttttgttttttaaaccaaaatgatcaatttgaaaattgaacacatttttggcctcagttttatcatgctcatgtcaactatttaatataaaagacctgccttttgggtagcctgtgtaacaatcaaagttttggcgctaccagggcaaggttctggggagcacacattcactaacccagctcccacaaccaccgaggcagacgctgtggccaggcaggagagctggggcaacttggagggcaacagggccagcgcagggggtgggaggtcttgggttggaggcagagacctcctgccttgccacgcgggggccaggcaggttcttccagctttggagtgaaccagacatgtgggctgagttctcagggctgtgtgacagctgccccaagtccctcttgcacgaggacaggaagagctatgaatatgtaaataacatgaaatataagcagtgtagctttttaagaaaggaaaattattcacacagaagaaagaaaaatgtcacgtttgggtttcaatttccagatacaactgatggttcactttcatctgtgacacttcacagaacgacacataaagaattttgttttatagtctgagcaaaggaaggtcaaaaggtctccttggcatctgagggcctccggcaggtttctcagcctccacgtcgtggacatctggggctgggtggctcttggttttgggtccccaacctgtgcagtgtgaggtctcagcagcatccctggaccctacccactccatgccaggacttttcctcagtggcaacaccaaaattgtctccagaaattgcccagtgcatgcccccactgctcccacaccaggggacaaagttgtctcttggttatcaacctctggtctctaataagagaaataaaaatccaaccacaaacatactctccagggatgtcttgtattgctggatgtgtggaccccatgtctgcctggctgtcagtcacctgaagatccactgatgctaactctgtacctggacactttgggttaaatggaaagcgtcctatgggtgtgcagcagagggagagacactcttcttagtatcaaaagtgctaggcaagccggatgcagtggctcacgcctgtaatcccagcactttgggaggctgaggtgggaagatcaccagaggtcaggagttcgagaccagccgggccaacatgatgaaacctcatctctatgcaaaaaattagctgggcatgttggcatgcctgtaatcccagctacgtgggaggctgaggcaggagatcacttgaactgaggaggtagaggttgcagtgagctgagatggtgccactgcattccagcctggaagacatagtgagactccatctcaaaaaaaaaaaaaagttctaggcaggtgcagagcgggcttacaggggatgcttgcagctgggggtggtgattgggtcagaggccttcttcagggcagtttatcaagtttttatacaacggggggtgggggcatccatatcattaagtcggtccctctataatgttgaggtgcgtcagtttccttacgcaagaatttcatttctcattgttttcataataaatattttgtccttaaaaacatcttgatactttttcatgtaaatctgtgttttatgataagtaatttgtaactggtttatttggacaccgccagaaactctagttgttcatttcactgtctcatctgtctggagacagggagtttcatgaatgcatctccagtgccagcacggggaaggtgcccaggctttgaatggaactgaatgcagaattccgggggcgccaggcaagccagatggccttgtgggcagtcacttcccgtggtcgggtggggcggggaaggccctgaggcgctgccggctgtgtaccgcctggcccagctccctacccgctgcctatgtgggtcacctctcagtgggtttcagggacacggcaaaatagacaacttccattttgactttgaaacctcgtgtgccaacacttgaatatgaatcttttcgtaaatgtacgtgtacatttcaatcagtttttgcagttagaatatattgttttgcagtcaatcttctgtatagctttatgtgtattattataaacataaatatagctacaaaaatggcataatgtattcactgtgcacatatttgtatatgtatgccaaatatcaatggttcatttcatgagcacttaaaaaaaaatcacatcttcatgggcttgctctgtagttacttagctacctacgcagaccccagcatttgggtggcatgtgatttagaaggcagccagcacctttctttgctctggggtcatgatcgctgagcccaccctcctccttgtacagtcctggaagaggactgcctgggagcatgaagcccagagtgagtgaatcagacacatgggctctggatgtgaaatccacctagcagccccgctgcatctggcaccaccatagggagcatatttttaccatcttttccgcagggtcagagtggccatcgtgcttatcacataaaaatgtaacctacaaaaattcaggtcatcagcccgtaatgccaccttgttttatcttggtgctatcttggtttgctttagaaacatagttcctgggatgtgtcctgttcacaaagcccagggtacaggtctgtgtggtgtgtgtggtggcactctggaagcccataagccatatatatatatttcatattatatattatatataattcaaatagaaattatatcaaaatatatatatttgaatatattatataatttctatttgaaataaaattccttgtacatttcctttaggtgtaaaaggaaaataacttacagtaaaatgtaaatctattagtattgagcacactgtgtgtggagcatcctgagtcaacacaggtgtaggcgggcgcaggtgtggatgtcaggtgatcgagttcacaaacagccttgatgttgtcatggagttttctgaaattgcaaaacctctggataaagttcctaaaaccatggtccactgtgggcggcaagccacccaggtgccgaggcaagagaccaagggcacgagctgttccagtataataaaatatataaaataagaatagttatactagatatcgatcttagatgtgattatatatgaatatcaatcattagtttgtagcaattactctttattccaatattataataatccttgctctacaatcataacctaggaaaaaccaggccatacagagataggaactgaggggacatagtgagaagtgatcagaagacaagagtgcgagccttctattatgcacagacagggccaccagagggctctttggtctagcggtaacgccagcatctgggaagacgcccgttgccaagcggaccatggtctagcggtagcgtcagtgtcaaggaaaaacacccactacttagcagaccgggaaagggagtctccttttccctggggggattttagagaagactctactcctccacctcttgtggagggtctgtcaggcccacccgcagttatctggaggcctaaccgtctccctgtgatgctgtgcttcagtggtcacgcttcatgttccatcctgtacacctggctttcccttttagatagcagtagcaaattagtgaaagtactaaaagtctctgataagcagaaataatggcgtaagctgtctctctctctcctctctctgcctcggctgccaggcagggaagggccccctgtctggtagacatgtgacccacatgaccttacctatcattggagatggctcacactccttaccctgtccctttgtcttgtatccaataaatatcagtgcagcctggcattcggggccactaccagtctccgtgtcttggtggtagtggtcccccaggcccagctgtcttttcttttatctctttgtcttgtgtctttatttctacactctctcgtctccacacacggggagaaaacccactgaccctgtggggctggaccctacagtccacctgtctgatttacacaataatttattctaagaaaatctagtctagttttaaattagtaaaaaaactctgtctagttacgtgtaaaacgaagtgaatgagttcagatgcaggtaaccaagttttgcctgcaggaatgtgcagcgggtgcaggcagggacatctcttgatgtggttctgctcccctattgtgggtgacttaacattctctccacccacctggtaggcgtggccatgtcctactaagtccttctccgcaccatccccacatgccagcagagggtgctgttgggcaggaaaggtgggacagcaccctcgtgagctgctgttccatttttccttctgtatttaggattgacatgtgtccaaaggatatggtgtgtgaagataatggggacattttggaatgccatttggaagaaatggaaatgcagagccaggaaggcgctcagagaggcctgagagatttctagcaaaaacctggtaaactttgaggtgaaggctgtcagaaacagctgcgaggagcatccagcctagggctcagcaggtgtgacttaaaggatcgcaggtgacagccctcagtggacttctgtcctcaccatgtttcccactggcacaggtggggcggccacgcctgtgcccgcggcgcctgtgctgagtcccgacgctgtgcgccccactcccgaggctgtggttggggggtcgcggtcgagctctagggcccccggccgcagagcccaggcgcggggagggcggcggctcccagctcccggtccccggctccgcgccgcaggcgtgaacgcccaacggagggcgccggcgcccgggagaggcgccgccttggttgcaggggccggggcgcggcggcccgggctttgagagacgggccgctcttcccggcgcggtgccttccagggaggctgcgcctgcagcaccgcagccagagccgagactccgcgcctttcaaggaggaggccccgtgcaggcgcccaggcgcagaggaggcgcggggggcgggacctgccggccagtcccttacccggggacagacggggaaggcgggagcgctcgcagttccctcctggagggaccacaccgccgggagcccgagcagcctgcggtggctcggctcgggccggcggagatctgggagcattttctggaagcctccacagacttcaggcggaccggaaggacctggcgggaggcgtagtaggcggggtgaggggatctcggtggcagcggggacagcgcggccccgagaactgagaactgagagggagacgctctcgggcctctcagaccagcattgaggagctgagccctgcgggccaggggcgcagagagggtcccgggccgtgaggggagggtcccgggtgaggggagggtcccgggccttgaggggaggggaggatcctaggccgtgaggggagggtccctggctgtggggggagcgtcttggctgagggaagggttccggaccatgagggaagggtcccgggccgtgaggggaggggaagatcctaggccgtgaagggagggtcctggactatgaagggaggctcctgggctgtgaggggagagtcccgggccgtgagaggagggtcctgggctgtgaggggagggtcccgggccatgaagggagggtcccgggtgaagagcaagctcatgaccctcatttactgggaatccattgctctggccccgtcatgagtggggttcgcagactgggccaatccctacagcgtatgtgtgctctggtgtctcggggcagcacagacgttgttactgctccatctggcctgggtgaacacctgggtctctctgtggagttgggggatgccgcctgctcaagggtcgcgttcctagtatgcgttccaggaatgctatgcaccaccagtgctaagccgcagaagagctgtcaatctgtcagtcctgtcccgctaaacctgaacttttttttttttttttttttgagacggagtctcgctctgtcgcccaggctggagtgcagtggcgcaacctcggctcacggctaattttttgtatttttagtagagatggggtttcactgtgttagccaggatggtctcgatctcctgacctcgtgatccgcccgcctcggcctcccaaagtgctgggattacaggcgtgagccaccgcgcccggccaaacctgaacttctgaaagagccagcctcttagggaaggccctccaccctacttgcctgggctttctctgcaagctctgtgcagaagggagcaaggtctgcctgatgccaccaccgtgggcccagtgttcatggtgtcctaatggaagctttgaaatcactttgtgttagtcctggctcttaagaaaatcgatgcaatgccaattaggcaccactattttttttttttttttgtataaaacatttgaggaagatggtgcagggtgggccctgaagggagtggggtcctgcctggagctgctgtttaggctcagtcttggtgctctatatacatatctaccattgcagtgtcatacagaatgttccattgcctttttgattttaaaaagtgtttatcacacaggggagttttagggcagtgcaactattctgcatgatccatgacattatgcacttctcaagacctaaaactgcataacaggaagcatgaaccctcaagtaaacgatatgctttagttagtaatgatgtatcaaattgtaatgtatgggccaccaatgcaagaagttataataactgtggaaggaagtggggcagagggggagtatacgaggactccctgtactttctgcccaatttttctgtaaaacccaaaactgctctaaaatataaagtctattaatgttttttaaagtgcttattatataaagaaatgattttgattcactatctttgggatctttttttatgagatttgtttaaagtagtcactgctttgcagtgatggcaccattcttctgggatgcctttttgaccttgagcagcagttcctgccctgctgagcaggaagacacagtgagtgggagacaagcctggatgctcacatggcctcatgccctggtctgcgaaatgggatggcatcttgcatcatggcggttctgtctagtgggagaatgataaagtgtgcctggcacagtctgtaccttcagtaagtgtggttgtcaaaagcaataattgggttggcactgacattcatcatagatgtacaaaagtaacatgtagatggtgaattgatgaggaggggcccatggagagatgggtttgtgccgtgtactttattcttctaattttcttattctctttgggactgtccctgtggcttccatgtggcttcagacaggtgaggagctgctgcgtgttcagaccggaaacctgagctcatcagcacgccagcccgggctcttctggggtatcatgttttgagaatatttgtctttgaaattttaaactctcttccatttgtatttgttgaaattctagagcttttgataactcatgctaaaatttttaaatcacttttcactttatcatctttttatttgaaatgtcaaaatttatgtaggaagcatcattttgccaccctgccaaagtattctgactaaaactatccaagatcctccaagaaatacatatgactaaagataatgtttctccctttctgataaaaaaaaaaaaactatagtaactttaatccctaaataaataaaacacatgtggttgtgacccacatgagataatcagtagctagataccttgtggtaaacgtattgctttgtttaatttttaaaacctatattgaagtacatgccttactataggaaattaaacattgtacaaatgggctggaagtgggaactacaaagacaagtcagggttgtattccagagggctcagagggacttagagttctgtgtctgctgatccagcccccttgagattttgctgtgatgaaaatgggtgtcacagatgaggtttcctcaaggtcattgttttcctcttaggtggtgaaactgacacctaacactccttgttgtcttaggacttccttttgaatgaattcagatacagaacctgaataaagggtgtatttaggactcgtagtcagaagaggcactgtgaggatgcgtatcccgtggctttactttagaaactaacccacaaaagacttcatcccaggaaggtggaacagacatactttttcttgctcttcccaagagtaaaacaaagaaccctggactcaatgtaggaagcacacacaggacaactctgagggggggaggaggaggcagaatagtcacgggcctgaggacccagggagcagtggcagggtgagttcccagggtttcttttggtctcgtgcgtcctaaacgcagggcttgtctactgtggtgtgtttgtgctcctataacaaaacatcacagactgggtaatttattaaaaccagaaatttatttcctcatggttcccaaggctgggaagtccaagatcaaggagccagcatcacagggtgaaaggcaggagggccagtgaagcctctgttagggaggagcccttgtcctaaccacctaccaaagaccccgcctgttcacagcattggctattaggtttcaacgtgtgatttttgaggggacacatacaaaccatagcattccacccccagctccccaaaatgcatgttcttttcacatgcaaaatacatttattccatctcaataccccaaaagtcttagctcattccaacaccaactcaaaaatctaaattccagagtctcctctaaataaggtgtgactgagactcaaggaacgattcatctgatgcaagttcctctccaaccgtgggcctgtgaaatcgcacaagttctgtgcttccacagtacaatggtgggacaggcataggacagacatttcccttccaaaaggaaaaataggcaagagggagtaacgggccccaagtaagtccaaaactcaacaaggcaaacaacattaaatcttaaggctgcagaatcatcttcgactccatgccccaccttctggacaccctggggtggggttgggcaccccaggtctcaggcagccctgcccccaggggttgctgggctcagttcacctcagcagttctcccaggctggggctacacactggtggctcagtaggtctggagtctcaggggtggccctacctccgcagctacactaggcattgccctggtggagactctctgtggtggctctgtccctacaacaagtctctgcctgggcacccaggctatccacagcatactttgaagtctgggtggaggagaaagccatgcccccacagctcttgcactctgtgtgcctgcagaattagcaccacgtggactctgccaaggatgactgcttgcatcctctggacacctgagccatagctgtgtgaccaaggagtgctgtgccagaatgtggagaatagagacctcagatggctgtgggcagtgaggttgcatgggtgtcctgggcttctctccctaaactattctgtgctgtgatgggcatggcaaccctgaagatctccgaaatgcccttggggccgttagtccataatctttatgaataacaccaggcttccttcaatccatactaatcttatgaaagtaggccacactgttggttttcttccctaaatactctttgttgttctttacatggccaagctgagaatttttaaatctttatattctgcttcccttttaattataaattttgtccttaaataattttctgttctcaaattttaccataagcagttaaggaaaactattctgaatactttgctgcttagagatttcttctgccaaattatcttagttcatcactcttaagctctgccttccacaaagtcctaggacatggacacaattcagtcaagttttttgccactttgtaacaaagaaaatgaaaatacagcatatcaaaatttatggaacacatctaaagcagtactgagaggggaatttttagcactaaaatgcatgcaatagaaaataggaaaagtctcaaatcaatctcagcttctacctcaagaacttcttgtctacctctctagaaaatgaagagcaaaataaacccaaagaaaagcagaaggaaggaaataactgaaatcaatgaaataaaacacagaaaagtggctgggcatggtcactcatgcctgtaatctcagcactttgggaggccaaggtgggtggatcacctgaggccaggagttcgagaccagcctgaccaatatggtgaaaccccgtctctactaaaaatacaaaaattagccaggcgtggtggcatgcacctgtagtcccagctactcatgaggcacaggagaattgcctgaacctgggaagcggaggttgcagtgggccgagattgtgctactgcactcccacctgggtgaaagagcaagactccccagaggtatcactacagactctgcagatatcaaaaggataataagggaaaaaactgcaaacaactgtatacacattaatttgataacttagacaaattggactactttcttaaaaagcacaaactaccacaactcacccaacaggaagtagatcattgaatagccctatagctattaaatacattgaattcataatttcaataaagaaacattcaggcccagatggtttttctaaagaattctaccaaacatttaaaaaattagcaccaattctacacaatcttttccaaaaaatagaggaggaggcaatacttctcagtcatctcatgaagccagtattacattgataccaaaaccagacaaaaacaagaaagaaagctagtgaccagtatccctcatgaatataacacacaagcccataacaagatattggtaaatatattaagcaatagataaagagaattatccaccatgaccaagttttggtttataccaaggatgcaaagctggatcaatatttgaaaattagtcaacgtaatctaccatattaatagactaatggagaaaaatcatataatcatgtcaaccagtgcagaaaaagtctttgacaaaatttaacacacattcatgattaaaaaaaaaaacaacaaaactctaggacagataggagtagagggggggaccgtcttacttattaatgactacctacaaaaaatacccacaactaacatgacactaaatggtgaaaactatatactttctccataatatcaggtacaaggtaaggttgtctgccttcatcgcttttattcaacattgtactggaagttctagctagtgtaataaatcaagaaaaataaaaggcatatggattggaatgaaataattgaaacagtctctggttacagatgacatgatcatctgattataaaatcccaaggattctacaaaaaaaaaaaaactcctaaagctagcaagttcaaaaaggttgcaagatacaagataaacatagaaaagtcaattgtctttctttgtagagcataaataccaaaattatgtacaccaaaattaaaaatacaataccatttaaaattacaaaaaaaaaccacttaagtgtaaattcacccaaatatgtacaagacttttgtgctggaaactgcatgatgctgatgagagaaatcaaggaagatctaaatgcatggagaggcataccatgttcaaggattggaagacacaatatagtaaagatgtcagttttcctcaaacagatgaacagaattcttatcaaaatcccaacagaattttttttgtaggtatagtcaagattatcctaaaatttgtatggaaagtcagaggagctagaatacctaaatcagtcttgaaaaagaagaataagatgagaggaatcattctacccaatactagggcttattattgccacagtaatcagggcagtgtggtcctgggcagactgacagataatagaacagaacagagaactcagaaacagacccacacaaatatgcccaactgatttttgacagagatgtaaaatcaattcagtggaagaaagatagtcttttcaacaaatagtgctgaagtaattggatgtccacagggagacaaaagaaccatgagccaagttttacaccttatattagaatgataagttctaacaatgaactacaaatttaaacatgaaatataaaactataaaagttttaggaaaaaatatagtagacaacacttaggacctaaagctgaacaaagagatcttagacttgatgccaaaagcatgatccataaaaggaaaaaatgatagattcgaccttaccagcattgaaaacttatgctgtgtgaaagcacctgcaaagtggatgaaaagacaagctacaaactgaagaaaatatgtgcaaaccacatagctgataaaggattaagaaatctcaaatctcaccagtacaaaaacaaacaattcgcttagaaaatgggcaacagacatagagacattccaccaaagatgccacagtgagggcagaagagcacacggaaaggtgtcagtcaatagtagccagtggagaagtgcaagacctgggtaccactgcacaccctcaggagagctaagataaaagatagtgccaacttcgaatgctggcagggatgtggataaactgggttactcctaagttgctggtgggaatgtaaaatagtatagccactttggaaaacaatttagcagtttcttttaaaacaaaatatgcaactctcatatgacccagcaattgcactcctgggaatttatcccagagaaatcaaaatttatgtgcacataaatacaggcatatgaatgtttatattcgtttatttgtcgcagtcaaaaactggaaagaaccccaatgtcttttggtgggtgaaacgttaaattgtacgtccgcaccatgaactattgatacctgtgacaacctggatgaactctccagagaattatgctgagtgaaaaaagccaattccaaaaggttactgtatgattccatttacataacattcttgaaatggcaaaagtgtagctgtggagaatagttcagtggttgtggggggtccacgaggggtgatctgggaggaacatgggtgtgtccaggaggggccacaagagggtcctgtgggtagagacagcccaggtctggctgcgtcattgtcagtatgctggctgcagtcgtgtgctgtagtttggcaggatgctacccctggaggaaaacggtacacaagacctctgtttactgtttctcacaactgcatgtgaacctacagttatctaaagcaagaaaaatcagttcacacctattcactctctgtcaacaaacccacatacacgcaccgcattacaagggctttaccaatatgtagaatcacgtgaagtgggaagagggaaaagggctttccttttagggaattatgaccttgactgacttaaaatcaatatttgcttcagatttgcaggtccagatctaaaagtttaaatagatgtcaaagtaggttaattcaatttcagtgaccttggtgttgagcctttgaaacactgcctcccagttaaggcttgaataagttaacagttctaaggttgaatcgggtgtgtttaaatattcagagccgggcagagggaggtggaaggcagcaggctacactgtgcttcgggctccctcctgctctctgtgagcctggactgaagcctcctctggttcaggctcagagaccttgcagccccacccctccctccagccaggtgggtgtgggtggcccagggatgcttcaagtggcaggtttgttttctggggatcccaatgtgatcgtgaacttgctgcatcacagtttcctgccaaccacctccttctaaaggagaggtgaggaggaatctccgttttcttcaaatgtttgggtctcccacagaccagtcaccggatcctcttggcaaaatgaggaccccaagggtttagaatctgaataactttgccttccttctccttatcttttcaatagtttgtggattgtttggggcatatctggtggggagaatctgaaagttgaaaataagcaataaaatgaagggtaaatgcattactattagtaaatttctaaacagggcaatgaacaccagctaactagaaactggcatgtccccagcatttgctgtttgggactggagtcatgtggagcaggaacatagcatcagttgcatcagcactcaggtttcactgtgctggagctcccaaaacctagcgttttatggtcccagggtgtccattgttccagcttcctctccatcaaaatgtcagagccactggccagagagaacacggggcgccccgtgtgatcagccacaaagcaggcgacactaaatgcccacttttggaatggactgtttacacggggggcagttggttctcagaaggtctaaatgggatgggcccgagggctgctgcttctgggtgatcctctgtcctgtggcctggacttgggccccactcctcctggagagagtgaaatggaatggcctctgtttacttcaagagttaaataaatacaggccttccttgcttggagccgtgttttggaatcagtatttacttggtgtgctcttggtgaactggaaggtacgtttccaggtctgcttttctgtaggaatgtggggaagctctggccatctgacaactgtgtcagccttggcgtcctcctcctccagcccccatggacaaagggtgggtggggttgcctggcccccttctcactgaaggagctcccagggaacatggcccagacaacagcacagctgcggggaggggctcctcggtgagaggtggtcactggtgctgaattgatatggtgtccgctcccctctcaaaaacaagctaaccggtatgcacggagccacagatctgccaagggtgttgggagctcgaagaccacagtgcctgctctgttccacgtaatttacctctgcagagacaggaacaagggtcaggcagaaagcaggggtgggaaagatcctgcctgcagacttcacctgtggccggtggttctagaggcctgggcaggagaccagctcagtctatgttttgtctgcccccagctgacctgggttcccagccacctgaggccaggcctgccttggtcctgcgtcagagccctccctgcccaggggaagtgcagacctggggctgagcctgaccccagccagaccccagcctgacaggagcgttcagccacctggtaggggctgggtcagacggcaaaggcagggaagacgaggaggctgccagggccctgctgtgggcactcgctgcctcacctctcctccccctgcatgtttccaggtcgcatatgagtgtctaggttgggaaaagggtctctgtgtggccaacggaactgtctgctctgagaacgctgtggcatgctgggcttggcttgtgcaccactgccctcagaatgtcattttattgttgatcttgtgcctgatgttgcgaagtgaggtgaggccattgtggaatgtgcactcatcctgggacttgctatgcacttgtcttgtcacccgaggagaggggaggtggcctggagcctggggcctgctctgtctccctggaactcctgtttccaggcctcacacaaagccacattggaagagaaagtgtgcccagctctgcccaccaagcactgtcctgggctttctcagctgagccttctcacctgtccacacccctcctccctgctccaggacacctcctggggctggaaagtggccgaggcaaccaccctttcctgaaacctcgaggaggcagcacccccggcttctgccagctgcatcctgacgtgctgttgatgccctgcttcccattgcgatgtggaggacctgcggtcattttcactccctcctcatttaacttcactatcccttggccttagtggagttcatagggtgaaaccagaggagggtttgcatggaatgactgctttgcttggagcgagcctccctctgtggcatggccctcagtgggctcttcccactgggctctgactggctcccgagggggcatgggtgggctcagggtgttttcagccccagtggctctaacctgccccatggtgcagaacagctgctccaggacctctggggtgctttttgcactctttatggagcttggcacgttgctgtgtaaatagcaggtgctcctagtcgctgctttgctgtgaaaagagaaaagcaatcctgaatatttagagctctgtgtgctacaccttcctgctgtcacctgtggggcaagtccagcacctggggggcctgtgggagccatgggaactcatgctgtttagggcgagttggtcacgatggctgtggctgcagggtcccagctatagtggaatccagcagccacagtttaatgtagatgctgtgccgttggtgacatggatacttgcatgcatcagacctccagagctctgctgagtgacgggcaacatggccgggaccctggtcccaggcgtagcctctctggggactcagggacccgagggaaagctgcctgaggcagcaggagaggagtgaggggcttcatgaggtggggaccccgtcccattgctcagtgctgggtccccagcatgaagtgtctgacacagaggaggcctcacacgtcctaaacctgcatcagagcaggatgagtggagcccagccctccgtcctgggtccccttaggcagtagccagaggctcccagcagcccctcaggaagctaccagcaaacggagacatgggagccgcacccgatgggtctgattgggtgtggctatttccatggcccatttttgtgttcaggttctgattgtctgaacgttgtgacattggctgatatttatttattgctcaccacatgcccggttactgttcaaatcaattatatgcatttaatcctcgaaataacccacaaggtggggactttgtgaccccattttacagatggggctactgaggcagagagattgagtaactccctcaaggtcaccccctgataactaggattggaacccaggcaggtgactctgggacccaaactctgaacccctttgccataaggcagactgcgctggaggctgtttccattccccaaaagagcccctgcgctcagcattttgtgagctttgaatgtggaagctaagaccgagggcttgtctgctgtcggagagtggccacctacacacatcttgaatgtgggtgcctttaaaatacagatatccaggagatccccagaaacgctggagaataaacgtcagctcaggttgccatcatttagacgttgcatttagtcccggaggatggatgccatacccaggggccagaggcattcttccctctggcttttcatttggtttcttttcagtatttggaacgtagaaatcaagtctggatgtcagagtattgatttagttttcttttttcccaggaggcgtgattaacaaagagccaaaatggcaaactgtgtggaggccgtggcgtgggctgttcctcgagagccgtgcttgtagggctggcctgggagggcatccctggtccgcagaggccggtctgtgccgcaaagcctgggcgcaggcacgggagtggcaggagggtcctggagtcaagggagcagctaaatttcaatgcagcagcttctttttgccagagatccaggttaaaaaaagaaaatgtttcaccttttaaaaaatatcatacttaagacctgcatttgttctatacccagatcatctttttagagccaaaacatcaagaaatatggcctgaaaaaggctcatgaaaatactgttctgagaattaagtgttaatgacattctgaaacctcactgtttaaagagatccactgctagtataacaggacccctgatatatttatgcatttataaatttataaaattcattgttaaaatcgagcaatgctggaagcgtctggcccacggatgatgaggaggcagagttttcagaggatgctggaggacagtgcacagctccctgccagtggctgcggctttcaggctgctgggacagtggccggatgcagacctgtgtggagcagctgctgctgctgcagcgaggttggccacataggtgacgccctgctaggcgcatccaggtccagcctcgaggttgtccactttgaggccaggtctgctgggaatccaggcctgctgtgtctacactctcacactccttaaactctcctgaccgggacacacgatgaggttttcctatcaaactctacatgcatttcgtatgacatctctggatttcatcagctccgagtaaaccaagccttacttacagccaggaaggcattcaatacccagatctggtcacattctgcccattggtgcatgttttagaagcatgtgtgtgtttctgcccacctcatggctgctgaggaacagtggctactgcgtgtcgttcttgtgatgcctttgtgattttgtgtgcagagccttatttacaggccgcccccgagagcaaaggataatggtgcattatctgttgacgtgaccctggagagctctaactgaactgcacaaatgggagaatcctcccctaccggcccctgctgctcacagacagtacgctcagctcagcaggggctgctcttacaaatgccatcgcagcacaggcggtcaatgcttggcattttctggggcccctggtttccttttagaggacgcagtattttcagaaatggagttcacatgtgtgctcatcagtcagcagcagtcagctgtgatgtctccaaactgtagaggctttggactttttggcccactttcttcatagaacgatagagatttaggatcttactgccctagtttaatcttggtttgcagatgagaggccgaggccccggggtcctgagccacgtgagctgggcttccaccctggactccatgccgcgcctcctcgccagatagacgccagatagacgccagatagacgtggccagtcgtgctgtttcaaggtcttattccagtcaggtttttgttttattgatttttttgttcatgaagtagaatatggttcatgtattacatacttttctgtgtgtgtgtttttattacaatatctcattttcatgggtttttataacttaagttacctctaacctatgacccttgtagtctcttcttccaccttgtgtatcctaatgtgggaattctgctttggtggatgacttttgtgaagtgaattaacatacatttcatttagaataatgctttgagcaactcaaagaaagtgaatttaattttatcacttagtttttattttatacttaaagagctctatttgccttattcagatttttgctatcagtgttgtatatacacaaagggaagctaagcaaaataacttggttagattttcctaaaatttcttcattcagcatccaactcttctgactcccttacctgggacgttccccagctgtcgccgtcagtcttcctcagatgccagtttgttgaggtgtttctctttccctgatgcctcttgtgccaacaaataaagactttcagctcttcctgggctctcgagaccaggcctgctgcattctcagagaagcagaaccttaggagatgcgtggacgtgcgtggttcgtctgtgccccgtgtcatgggctggcttatgtaattgtgcggctggcatgtctgacctcagtagtgcagacacaggctggagacccacgcaggatttccatgtgacagtctgcaggcaggtgtccgcttctccgggggaccctgtcctattctcttaaggccatgcagggattgaatgaggcccagcccactgtggaggggcacatgctccattcggagccagctgaccgcaggtgttaatcagccacatccacacgacacccgcacagcccccgacgagggtgggactgggtggcgggggctggggcctcagcaggctgacccctgacccaccaaagaccaggctgcatcctgactcaccttcctcatttccctgaaatgcatcattccttcctggccacctgcctggcacacgcccaggctgaccgcatggaccatttgctgtctcctagggtttgttacttcccgtgccttcattacccctggggcctctcctcatgcagctcctcaggcctggaatgcccccagccctgctcgtgtgtgggatacgtgtgccaggcacctcctggtgggattccaggttctgccttggggctaagagcacctggaggctcaaggtgacttctttgagaccctcccgcacagggtctggatggctcgtgggagagccgtgaacacagaagctgccgtggaagcaaatcctgggcgggaggatggctgcacctccccccggagagcaccggggtcctgcaggaaaagcagaggtctcctgtggccgctatgcctcttccagaaacttccgtacgcacagaatgagcgtcgcatcccaaatgcctggtagtggtattgcggataaatgttaacctagaggtttttatctgaaaagttccagtttaatttttaaagtcttgtttttaccaattctgcttgttcaagacataccatatgcttttttcctctagtttttcttttagaaagaatttaatgaattgtgctgggatcaccctcatatcgttctccctcaccaccccccgtcctccgggtctctccactctggccccagcagttggcgtgtcagttatatttatattatacatcctgccatctggggctctcatcgagagtttctcggacatggtgtgacatcagtgggtcctttgtttcagaacaagcgcgttctccttactctctggcacggcctcggtgtttaggggtttcctctctctgggaagctgttccttctcgagaacacagtgtgctttgttcctgcagtgagggaggagggtcatcctggggggagaactcctggcagcatacagaacaataggacaggaggatactgtccatggctgtctaggtctgagctgttcaaaggtattctccatgtttccatgcgtttgacttctaggttagattttctccctattagagggaatatctcattcctctagcatagacagagggggaatatctgttggcaagagggatgtcaaaacccaaaagtgaattattggtagcaacccacgtgcagtacacacccacgacaaccaagctgcacagtggcctggcatggtgtgtccacagcagcaacgcaccggtgctggaaaccgaatttagactatttggagtgcacacaggctcacgaggctttctgaatggtcgtgcctgtctccatcatgggagatgcacagtggacacgctgtggcctgtgctgtctgtgacggcagcagcacctcctgcaggtgtggggagagccctctctctgttctcacgcgtcgggctgcggcagaggtgcctgtgtcaccgaggtccctcggtaacttcagggcagaggccttctgtcccggacgcctgccctcaggggctgtgtctttgtctgttttctgctgctataacagagtatcacagattgggtaatttacacacaatggaagtttagttggctcatggtcctggaggcttggaagcccaagattgaggggctgcatctggtgagggcccctgagctgcgtctttccaagagacggcctcacccggtgagagagcggagagaccgagagggggccaagcgcgctctcacaactgaaacagcgctcgtccagtcatgagggcagggtcctcagacctggtcacctcttcttaggccccatgtcccagcacggcggcattgggggtgaggtttcccacacacgacctttgggggacacattaaaccccagcagactgccttgtcccctgctcattttggttgttgcattgaaatgtgggtgtgatggatgctggagtttctctccaagggggcgggataggctgtcattctggggaaggggggctttggggtttcggtgtccagggctgtgtcagtttcctattgcagttgacagatcactgcaaacactggctaaccacacacattcatggtctatagctctggaggccagaagttctaacaccaaggtgtgagcagggctagtcccttctggaggctccaggaagaatcctttcctcgccctgtccagccccaggtgctgcctgcattcctgggctcatggccgcaccacccagacccttacatccatcctcacatctcctccctgcctgagcctcctgctgccctgctggaaggaccctgggatgaccctggatctcctggatagcccccaatggctctctgtggtacgtgggggcccaggttctaccgtgagtgactgcaggccgtgccgcagctcaagtgggggcccctgaggggcctccagtgtttgggctgcagtgaccaggcatcaaaacacacacttccagggatgttggggtcctccctgaccctgctcttcccatgcattcctaccaaggggagtctgctatgcctccacgttgcatctgctatgcctccacgttgcacctgttctccacgtgtgtccatgtgagcacacggcagagccctgaagacttctgaagatgcgggctgctaagctttctgcatataccaagtcttaaaataatacaaaatgtgatgaagtgactctgctgttattgtattgtcattataataaaatacaactgggcactaatttgaaagtgtcgagtgatctttgcaggtattcactgctttgtacttgggcaagcatttgccttcccacgagcagtcttctgccttggggttcggttggccctgcgaggagatgcctggttccccaggggtaatcgtgcagcagggctgggggacagggcctcaagtcttcctctaaaatctgaggagctctggttcctcctcagggaacatggtcaggcctggtgggactggccctgccgttcccttcctgctgctgtgggcttggtgtggggtcccaggcccaggccagagcccacccctctcgaggcccttcctgccatggcctggccgggacctgcagccctccttcccatgtctgtggccacacacacagctgggctgttgagggcatccccactgctacttcccgggagctgcagtcaccctcagtgagcccctctgtcctcctagttcaggtccttccggaaggtgcttcctgtgacactgagtcctcgccccagcccaggagaggccactgatggatggcctgctggggtacggaatcagaggggcctcctgccttgctgtgaccacgagaggccactcattcaccctcactcccaccctcccgctctgctcctcactcacccacctcctccagtttctgcctgcgccagcttctccgttgcacagcgaggggacatgcacacacacatgcacacacaaacacgcttacacatgggctcacacccaggcatgcacacacacacacggacacgcacacacatgcacacacaaacacgctcacacccaggcatgcacacacacgcacggacacgcacatgcatgcacacacacactttcatgcagacatgctcacacctgtgcatgcacagatgcacacacacgcatgcacaaacatgctcacacacttgcacacagtcacacttacacatgcacacacacttgcatgcagacatgctcacacatgtaggcacagatgctcacacacgcatgtacacacactcaggcacatgcacatacacatacacacctgcacacacacatacaaacacacatgtggattttccatctagtgaggtggtgctgtctcctcggaggcctgcatgtgctggtgggttgcggtccctgtgtggtgtcggctgggcctgctgtgctgtgaggagccagccatgggggtgggcctcacttctagccgacccagttggtggccacatccctggtgcccaggcctggtccctggccagtgcagccttcacacctgacagcatggacagacccttcttgcccagaccgcagcaatcaggcactccctctccttcagcttagggctgctgggcaaagcacaggcctaactccggagcaaaacccctgaaggccccagctccctagccgttctcccgggacctccccccaggctctgggagggaaggccccaacccctacccagagagggtatgaggaaggagccccccgtgtgcaccggctctgcccctttctccagggtacaggcagaaggggagccccccaggcagccgatgccctcaacacagtagtttgctgaacccagaatccaggcatctttgccttcattttggctcttccaggaagaatcccgtaggtacccactgctgaccaagcatctggcctgtccagatgcggggtgtgcttcccctctctgagcagctaaaaggtgtttgaaggggtgggtcccgtgggtgagaacctgtctgggcctggagctctgggaggtggacgaaggggttctggaatattccaggctggtgccagatctgtcatggcagccttctctcatgcctggctcggctctgccctgggcacagacgtcccctctgaaagggcccgtggctcccacccacctccaccactctcagcagggaatgccgctgtctcttcacgtcctcctcccaaactggggcccaggcatgtctcgtggaatcttaagttgcttttgaaggaattctttctccatggagcagattccttctcctcctctggcagggtctgaccgtgctccttctggccaggattctggggcctggcatcagagcgggtggagggtcactgagcctccgcagctcctcagagcgctctctttgctcaggactccacagcgcggcatggctaggagggaatgacttgtgtggggactgggataggcaccaggtggaacctcaggtctgtcagcaagggccctcagggggtccccagggccactcacctccctgcacctgtgtctccagccagtcctgcatgttgctgctccatagcctgtcttggtccctttcctgctattgtgggtagaattgcgtcccctgaaaagatgtgttgagttctaacccccagcgcctgtgggtgtggcctcatgtggaggtagggccgctgcctctgcagatgcatgagctcagatggagtcgccctggagtaggaaccatcatccaaccaccggtgtccatggaagacagggagagatacagggagacgggctcgcagctgggtggggccacagccaagagtgctggccccccagaagctggcagaggcagggcggctcctccactggcttcagtgtgcacggccacgccaaccacccacttgctccaggccccagagattccaccccaaggacgcaggggactcagagaggcttggcctgcagcccccactggaagggctgtggatggggttctgacacattcgatgtaactgagagaggttgggttaaccaggctgcctgggaggagacggcgtccacttgcaggtgcacttcggtgcagggttgcagggggcgggggggcgggggggcccagctggggctgtgcatagcccacctcggatggcccctgcccacagcaacaactcttgaggttcccttgaggcagccccggcaccccaggttctacagttgcccacgttgatgtcaagctttgagttgtggttcttgcctcaggagcaggtctccccaccatgcagaaatggtctctagcttaagtgagtttgccttttgttttttaaccaaacaaacccatcctagcaatacccgggctgcccccaggatggcatgaacccatcatgatgctccctgcgacagggaacccctgccaaggaacaaggtgcagaatcccacagcgccctgtgtctgctcatgtggatgcatgttaccataacacggcacatataaaaatcatgtacagatttcagaaactttaaaatagccataccctttgtcctgtatctctacttgtaggaaattaacacagagaaacaatcagatgtgagataatgatttgcctgtgtgtttctttgccacagtgtttatgacagtcaagaatcactagaaaacctgattaaaatttgaaacacacatcccaggaaatattcactcagctatttaaaatcatgtagagtagcagcatcatgaaaaaacgtttaagtgaaaaatttgttacaaagaatagacattgctgttacaattttgtataaaaaggcatcagaaggataaagacctctaggtgatgctgttaaagtatattttatttttattttctatattttccaaagtgaacacaatgattttatactcagacaaaaatacatattaagttacttgtttcatgcatcacaacgtaatggtcatttgtgtgagaactttagatgacagagtccaggtcagcaatcctgccagattttatccccaaaagaccatctcctcactaactgtcctcatcaactgattctgcgtttatagtttatgttaatgtgaattccagacttccttgctgggcaaagccataaaaaaagtcagaagtccagcagctcctcctcttccttcctctcctgcccctcccctccctgtcccccacttcagaagtgcagtccttcagtcgtccgtgtgtggaccaggacctgcttgctgctgggacacagggacctgttcacacgtcacactggccccggagggggaggtgccagcaggtgccctcccgtcaccacatggaggctgtcacatacccaggtgccatgtcacctccgctgcagcatgagctctgggcacgcaggagtcaccagccttgctcagtgctgcacctcagagccagccctggttgtccggaatcgagggttcgtttccagatttctggggccacggctccagtgcatccctgacatgctgggtgttgtcccgcggggctctcccagtcacaatgagcttgtgaatttcctcacagtccttttccagtctctaccctctctgatacccctcccaagacatggagtgaggctgtgcaggaaacacctatgcctgcccttctgtggccggggccactgtgccactccatagccctgctcccctagcctcggggttggctctgggagcctggccctgcctgctccagctcccatttctcacctccgctttgtggctgatcatccagaaaggtcgccatgaggatgtttggtatccaggtgtcgctttaccttcagcctccctcctggggcgcctctggttcccgggagagaggccgagccagggatggaaagaagcccatcccttgggacacacggcttgggaccttacctaagtgtcctgggtctacctgtcgggaactctgtggatgccattcccctcacgacactacaggcgtccccgatgcagacaccacaggtctgcatctttgtgcctctgtgtggcctggggcaagtcgctgaacctctctgcatattctgtaaaacgcgaaaaacagtgccttctcccagctctctgtaaagaccaatagtttacagcatggggagcactctggcaggtacctggagcgcctagtgctccctaatgccaggtgtaatggtgacaatcgttctttaggcaagtattaaatgatgtttatggaaagatggcatcatctgtgctataatttaaggcagaataaagactagacagagctagagagagacttagctgaacaaatcagctcctgaaattgtgggtgttggaaggtccaggggcagctggggactggggagagttgggttgcagtccaggctgtctgggagcagagctccctcttcctcagggaacctctgtctttttctctcaagccccttgatagattgggtgaggcccacccacgttatgtcacacaccttactcaaagtctactgatataagtgtcaatctcatctaaacataccttcacagagacatctaacctagcatttgacccaatatctgggcacggtggcccagccaagttgacaagtaataaagccaatgaccacagagaccaagggtctccaccctggtgccccaacatgacatggtgccagccagaggatattggccaggggacagagtggatggcacagggttgaggaaagaagccaatagcatgtgtggagatgcccaaggggtgaagagggagatcggagaagcgggacaggccagagggtgtggccctttcctttcatcttgcttttaagatgcaacagatttcagcagtgtttctcaaagtgtggaccagcacattcaacatcccaggaaattttgctagaaatgcacatcctcgggccccatcccagacctcctggatcagcaaggagccatcagagcccagctgtgtgagcttaacaagtcctcggtagatcctgacgcagcccaaggctgggcaggctggagggcacctgcatgccaggagagcggccgggagaagagggcaggtgctcagagggagtgtggcctagggccgtgtgggctgaggaccagggagggtgttgtgccttagactagtggaaagggcagggcctgcatttcaggacccttctgcctgatgacaggctttccctgaagctggaggggcagggttggggtgggggggcggtgggggatggggagtggtgaaggttccctgaactgacagggaatgagaggagcagacccatttgagggcactttttgcagaccatgtgtagacaggaggtagcaattgtgccgccgtaggcaccctgggcagcccagggaacgcttgtccacagagggagaggctcccatccactctgaggcctttccagagttctcctttcactggtctccaaagagattctgtagaaccaagtgaaactgctgatactcaatacgtttctcatgttaaacaaaaacaaaaacaaagcagccatttcttacagatttattcaatactttctatctggttattatgcctcttattctgtaattattttttattatgaattatttatttccagatctgtctggcctataaggcctgtaggcactataagggggagtactgcgtcaccttcatctttttatccctttggccttgctccgtgcctgaaagctcaccacactggaacgtccaggtgcacatgtgccactggacaccgggatgttgccggatgctcttttggacgctggaatgctggtgcattgttgccggatgctggaatggtgcacgcacgctctgttggacgctggaatgctggtgcattgttgccggatgctggaatggtgcacgcatgccctgttggactctggaatgctggtgcattgttgccaaatgccggaatggtacacggatgctctgttggacgctggaatgctggtgcattgttgccggatgctggaatggtgcacgcatgctctgttggacgctggaatgctggcgcatgtgcacatgttattggcatgagctgtagttcaaacctcagccatatgatgcttgaattcccaaaccattcgtggaaatgtgtacttcttcctgctggaattctctctctctctctctctcttttaactgattggggagtgaggtgggggggggggtcttgctacattgcccaggctcaaacttctgggctcaaatgatcctcctgcttctgcctcagcttctgcctcggcctccggagtagctgggactacaggcctgaaatactgtttctttaaggaagggcatgttacctataataccaaaccacaaaaggatagctgcggttttgggcgaggagagctcagagagtttcttgcatatggccctgtgatggcggccatggccctgcatagacacgagctggaatctgcaggtggcagccaggacgctgcgtgtgtcgagtgcacagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggaggtaaagggaggcggcggccaggcgcggccccgcggaggcagctgcactcgctcggtccactcgcggcttcgcggctgcccgcaaaccaggagggcgtggagacccggaaccggggggaagggcgggggcacttgtgcggcacccgcggggctcccaggggacctcggcggtgacacgaatttctaggtgaccttggcggtgacacgaatttctaggtgacctgtgtgatacactaggtgacctagtgacacaggtgacacttccaggtgaccgcggcggtgacccgcggggctcccaggtgacctcgttggtgagccccggggctccccgacgaccgcggcggtgacacgcggggctcccaggtgaccccggcggtgcactcacaggactcccaggtgacccgcggtggtgacacaccggggcgggcgcgcgccgcttccgcttccgccgagccgccccccgccccccgcggcgcagcgcgcgcccccctcccggtggcgcggaaccaatcctgggcagggaggcggcggctggaggctgaaagcgctgccgtggccccctccccgcctccgccgcgccccctccgcactcgcacggccccacccgcaggcgccccccgtgcggaggaagcggatctgccaggatcatttttgttgtgtcggaggatgaggttttggctgaggactgaagagatggccttggaagaaatggtgcagagattaaatgcggtttccaagcacacgggtaggaggagctgctggccgtcagtgatctgtgcttaagcttgacatcatgggctgaaatgtggggaaatgcgtctgatttttgtaagccgccctcgtgttcctttctagccgtggtagctgtgacatggggggcactggttggcagctggtgtgttttcagaggctgtcggcgatcgtatgctgcccgggatagtcaaaatgactgcacgttggtgacactggctctctcagggttgctgggtctgcatgcggagccatttgtgtgtctgaagtctgcccatcaacctgcctgtccgcagccctcgcaatggagaatgcattgcgaatggagaatgatctgagccaagggctttcagagcttggggtttcagagccaggggtagggatggtgaagctacctggaagctcgttttgaggatgaaaaaacctggactaatcaggtggttcttttcttcattaaatgcaatttaaacctaagacagatgtttgagacggtatgggtaaagagtggactggacgttcattttcagtattaatcgaaatattacttcaaataagctttgaagagtagttcagatcgattcttttaggtgtaagcagagactgggctgacagcttgcatctggccgtggctttcaggcggtcgcatctgagttctcaggctgtgttatgcagaagggagaggcatccttaactcgttttccttgaaatgaagaggaaataatgatatatcattaaaagtaagttgccaagtgttttgcctgatgttgccatatgttatgtcatatatgccattactagttgtctaactagtacttgcctgggagattaaaatgtcagttgcttggtttgggtgtggttctctttctctgcccaccccgatggattctgagagtgaaccagtgattaaatcagcataagcaccatcgtatgggatggtctaatcaagatgtttttaatgggggcttttatgatcaaagctgctgggtttattgtatgtgggtcgaaagaaaacaaaaccattttcatgccgtctgctccctgattcttagagaatcagctctttttctgaagcttgagtggagcttttccgtgcagggtttgcagggtttgagtatggtgaagggctgcgtggatgccaggttcacagggaggcttccgatcggctgtgggggtggaggagaaagccccccttgctctgcatgcctctgcgtgccgttcggtgtcagagtcacagagtgggaaccgctccagaggctgatgtcattccccaggtttttagggattggggtttcttcatgagctccaagagacatgtgcgcatttttaattggaaaaaggctatctcagaagagcagcagtgacactgtctgctcactgaatgtcgtgcgagccgggcgctcggtgtgggccatcgtctcatctggaacaggcagtgagatgtgcgtcctcccacacatctgcattaccgataattgcatgcttcaccaggactttcaagtccagcttaccagatatcctcggttatgagcaccctgtagcgtttagttaggggaggtgaccctgcatcatactccacttaccacccattaacactggcctcttccttcagcacaaacccattttctgctcacgctgtgtgaggtactgctcagcggaggcaagttattaggttgaaggctgtaaaaccatcatgagggggtttatgatgcagtattgacatgatgctaccacagagtgtacgggtatgtggtgcacattctctggtaggggtgaaggtcaaggtaaacctgatccccacctcgggtttaaattccaagcacttcctcaggagagttccccacctgcagccaaacactcttcagcgggaggtcatggagctgcttctccttctggggtcatgctaggatccgtgccaggtaaaagctgatggcaacaggacactgatgtggcggctggtgtaggtcctcagggcagtggcggggctaggtcacagctgagggattgcgtacagcggctggccttagagcagctgcctcattcagctgtgcagagcttcaccctctgtagattcacccccaacccacaggcattttatctttgctgctgtccaggacatgctgctgtgttttaatttcagatttatgcatttcttctgtcacctagaaccttcattagctaggctaatctgcatgtaaaggaggataatgtgtgctgtccatatggtctgtgaatctgtagcctttgaccttgagaattgacattttatatacttttctgaacctgatcttcagtaacaaggccaggggcactttccagtggcaacttccccctggccccccttctatgtgatagggctcattttcgtctgttttggttttctctttggaattttagtcattggtgaaaaggtagaagacattcgagggagcaatgctatggatctagttgatttaagcattcgatgaaacagaacagtggtcctccaactacagcatgtacatgcgtcaccttgggggcttgttaaagcacaggctgctgggcccaccctcagagtttctgattcaggaagtctggggtagggtctgataattgacatttcttaagttcttgatgaagttcttcaggaatcaaacttggggaactactgtggtagaagaatctttaaatctagccccaccttttccattagttgacctaatactaactcttgtcatagacagatgatgatagatggataatgcatggataaatgagtggatggatggatgaatgggtagatgggtgggtgggtggatggatgggtgggtggatgaatgtaggggtggatgaatggatgtgtgggtgggtggatggatggatggatggatgatgatggatggatggatgtgtaagtgggtggatggatggatggatggatggatggatggataaatgagttagtagatagtggataagtgggtggatggatgggtgggtggatgaatgtaagggtggatgagtgggtgtgtgggtggatggatggatggatgatgatggatggatggatgtgtgagtggatggatggatgtgtgggtggatggatggataaatagataaatggaggatgatgaatgggtagatggatggatgagtggatgcttggacggatgagtggatggatggatggatgaatgagttggtagatagatggatgagtggatatatgtatgtaaggtagatggaggggtaggtggatgggtgtatggatggatggatgactggatgactggatagatgaatgggtgggtggatggatggagggagggagggatggatgcatagatgagtggatgcatggagtggaggagtggatggatggatggaaggtggatggatggatgaatggatggatggatggatgagcaaaagctgtgtgctgcctcctgtccttaagctcttcctgggaagggcctgtggcctgagcaatgggctgagggacacagcagcacggaggggctttgggggatgagggggcttcccaggaccaccacacaggcacagctgttcggcaccccccagttgcaggtctcagaggaaaagctctggggggacgcgcccaggaggcaggggcacgcatttctgtgtggaattgaagagctctcagtggagtaggtgcggctccctggcaaaatgccacctgcttattagccagcccagcggtttctgacggacgccttagcactcccctctcacgcctctgccttcggcctcagtgattggcgtctcctcaaggagccatgatttctttgtccattttttaaatgtgctgaggccctttaggagaaaaaccacgcagccaaatgaggtacgtctgtgtgggttgctgactattttgtaacatgaaatttaggtctctaattagataggtgtgactataaagtacagaaacatttaaaaaacaattagctttcatgggatgttgttatggatcttgttagtagggattccggagcaggttttagagatttgagcggagggaggcttgtgaggaaaccgtgagtcctctgagcatccttggtgtcctgtgttgctgaccttctgtgatctgacgccacggctcagtgcttcccaagagctcctgagaacgcagcgctcaggcctcccagctgggtgagtctgacgccctccatgcgaagacggcgcgagcacggcttcacctgtggaaccaggggcagacttatgagctcccgggggtttcagttccggcctgctctgaggacactggggggccggccctgtgtttgcttggagcgcccttcagggagacccgtggctccaggggctggcgctgagtgaccacaggcaaggtctcaggagtgagtgatgccaggcagcacctgagaaggggatgcctgcgaggtgtgttccgagtttcatggggacttgtgttggccaccgcctcctgagtcactggccccttttcacgctgcacctgtgccttgggatggtggccgccttccagcgtcttcctgatctccgtcttcaaagccgctcctgactcttccactgccccctctgaccccatcccccactgtttcatcagctcccatcctggcgcttcctcacctggtgcctcattgcccggcacttccttatctggcatttcatcacctgccgctccacatcacctgctggcttcctcctcctttagtcttacgtttggagttccctgcatttggcttccctaagggtaagaccaccttctatagtggtgcaaactccccctcagaactaggggcaccagttccgcaaaggcacccgggcatggctaacctctgagtctgcaaagccccttgcgtggctgacttccaggtctgcaagggcccccggcgtggccaacctctgagtctgcaaagcccctggcatggccagcctctgagtccatgaagcccccggcgtggccaacctcattggatgagtttgcttggacttttgcacccctggcatgctgctgttctgctgcttttcataagcctggccccttgggtgtggaaagtgcatggattttaggggttccactcattttgcagacgttctggggaaaatcacatttgttgatcatcaataccagctgaataccagagggtgcactccagaattagaccttcagggactagtaaatatgagagatactggaggatgaactccagaattagaactttagggactagtaaatatgagagaagctggctcgggagacctgctttcgccataataaaaaacaaggcataagcatcacaatcagaagttctccaggcttcagctgctcatgaaaggcatgctatgtctgacaaacacattttcatgagtagagaataattttaacagactctagggtctactgactcataatttaaccaaatacagtttctggagccaagctggttctgcagcctaattatggaaagctcggctgccttttccgtgtgtttcgtttcctccgccgcctacgacgtgcaggcagcactctcaacatagccccttctttcaccagaactatcgtttccacgtcagctcacgtcaccatccgtagagttggaaggataccactgtaagtagtattttcacacttctacccttcggattaactcagaaggtatctggtcacattcattttataactctgggtgtggagaaagaagcatctgttacgccttttggaatgtttacaagctaactgcccttgtctgatacacacacaaaaatggagctgcctacattggaattctagcgaagtactgaagttagaatgtctaatgtctggtggtcatatgtggataagatgtgggatgaggtttgcaccttgtgaggttagcggggcccctatgaagggttgcattgactattaggttaaaatcactggtgctggacccgtgacctgtgaggtcaaaccccagctctgccatctgtggctgtgtggtgcctcggtttccccatctgcagaatggactcaggagagcacctacctgctagggttgatgtgacaatcaaatgagttaaatctgcatgaaaagcactgagaagcacccagcaggcaggaagctgtggggacccgtttgctgttagggtcacttgtgcacatggtcagtgccggcgggtacccgccatgagcacctgtgcacagcagggagccgctgccgtggtcatcctcagggagccgctgccgtggtcatcctcacatacagttaggtgtgtgaccgcactgacgatcccagtaatgaagtatgtggggattttccaggtaaatgagaaggaaaaggaaggttctgagaggaagggtctgtggttgacctcgttgcggtcgcacggtgatagaggtgacatccgtggtcactgttctcccagatgcccacggtcgcagagagctcgagcccgggcttcagcacgcagcacctcacaggcccctctgccatagcaagctcctggcctccctccctccctccttccaccccaggagcctttgtccagtgtaaaccccaggagatgcgcagtgctgggaagaaactgaacctttgggaagagacactcaagaaaacttacagttgcgagtttgaaaatacaacagatccgattgttccttctaaattatgggattgcctggcatttgcctctaaattgggctctcagcgaatgttccgggtttttttttttgtttgcttgtttgtgtgtgtgtatgtgtgtgtgtgtgcgtgtgtgtgtgtgtgtgtttgctttactcctttattaataatgttaaagaaatgagacaaatccccaaagcatgaaaaccaatttctcagcattagtcatattacttaattgtgctacttaattcactaaaggaaagaactagtattaagtttcattaatgacatttttggcaatatattagagatggtgagctaatgccccaaacaagacttcgtttctgtaagaatgccttatcttttaaaacgaaacttgtcatggacaatgaagagaagcattccagctggagcacctgttaaacgctgcacaggggaccacacgcggctctgggctcggccttcaggtcgctcatggggcggcaaggctgtggcggacggcagtgtgtgatgctcacgcggggagcagcactgggtcacctgcacctctgaggcagagctgtgtggccttcccagccattcaccaaaggtgcctccaccagaccggagccacgaccttccctggcgggtcccgggctgggactgaaggagaggaggggctgctcggtgagtggcctctcagacaccatggcgggaagacgacagagccgtgaggagacacacaccaaaccggacacacaggcctcctgggcagcgggaaacctggagacaaggacctggtccagcagggctggcgcagaggggttggggtcgcccagtcggacagtgcggggcttcccagtgctgctgtcactaccctgtgggggctgcatgggggagtcatcggtttccacaagcacgctctgtccttccctgcaccccacgctttactgagagaggaaacgagacaccttcgtctgtgccacaacccaggtgtgcacggcggctcccacccgcatcagcccaggagcgctgaattttaaatcacccaacagctcatttaagaccggccctaaacaactccctactccacgactaatggagtggctaatgtaagactcttttactgccaaaaatgataccacttactgatatggatttcttaacagtagcttggggccacattgtataaaatagactcccggggttcacaaaagtcaacccacttctcaggggcccaaccattctcgagcctccctgaagccaaccagcggggtgacaggaagaacttggatctcacatgggttttttgtgttttctcatggaggggctaccacggagcttagggaggaagtggcccccaccagccaggagaggacggccgcgttttcacgatggtcgctgaagccaaagcttgtatgagctacatataagaagaaatcagcagatcgtgagtgaggttcatatctcaggattaatttttgaaaaatggttttaattagtaacatctttaaaactatttagatgtttaggacattgaatgatgaacgtctgtgcacatccaatctgcgcagctggaagtggccctgctgttccgatttccttgacttcctcagcaccttaccacgcacaagggaaggaaaggcagagagagaggtttggtgttgaccccagaggcgaccctgatggctcccgtgcgcaccgctcactgcttccgtgaatacaaagcctgtctgcgtctgtccttgtggatgaaaccaacatttagggcttgatttcctggttattcaaagaggcccttggaggctcaccttaggtcaggagttggagaccagcctggccaacatggtgaaacctggtctctactaaaaatacaaaaattagccgggtgtggtggcgggggtctgtaatcccagctacttgggaggctgaggcaggagaattgcctgaacccaggaggtggaggttgcagtgagctgggatcatgccactgcattccaatctgggggatagagcaagactctgtctccaaacaaacaaacaaacaaaaccaaagaggcctgagctctggaaacaccacgcgaaatgcgccatctgtttccccattttcatgtgagtcaggttagggctgacctgtcctgggcttgcacacaagcccccaacaaaacggggttcgtggtctctgctcctgggtggctgagacatcgatcccatcaccctgctttcctctgtagctgttttgggggatgcagcacagacagcaagcgtccagctgcttcaggggacggcagccttgggaccaccttgttgcgtctggcaggtgggtgtggaaggcaggagggggatggtatgtggagctctgtctttcctggcagaagctggctctcaacacctgtagctctcagaggagcaaacccagcacagaacactttgaacagaatcactgtatttgtggaggctaataggacaccaaggcgccacctctcaggctgtggaagcagccttttcctcttgatgtccccgatgccagtgggaggacatggtaggcagggaccctccatacgttctgggagcgcctgtgcagggtggcaggacgggtgtgcactcagtaaacaatgttgaataaatgccttcttttgctgcaaaccagatgcgtgttctaatcacatcagctcacagaagggcacatgtggtgctccagacagcatgtgggctttcacaagcaggcctgagcgccagccctgccaccttctcttcctgtggcctggagcacataacaatgagttaaaatggcactaggccatttgcacggccttgcacatcagctgtgaggcctggagccctgtgtgtgcccagcacggtgcccagggactctgagagcctgagggtggcacgtcacctcgggggccattgggagccctggatgctgtcacctctcacccctcggaagcagccatggggcagagggtgggagctgctggcttgggacgggctcaacacctcttggggaaaagcatctccggccacgcaaagcaacctcatcacttcctccctcgaggagctcggcagcagacgggagccacaggcgtggaacttcccactttgtttcaggacagccagcagcacgtccctcccttcctctgggtttgtagttgtttgtttgaacttgagacttcctgaggcctggaaggtgtttttggcttgctccataaggcaaggaggtccagcccacgcaagcccccgccctgttcgaggaaggaaaggcccagaacttgcacacagcaggcaggcccagcggctgggtttctctagcacctcggcattgtctgcctgctcttccaggcgtgcagggcagtggtggctcgggccaggctctgggaggccgggcactctgaggaggtggctcagccctcttgggttctttcttgtgagttggcgaagcccagagtcaccagggtcctgagcacctgtctcttgtgaccatgcggcacccgcccggcttttagctgtcgcagcagagacccgaaggctgtggctctagcatcagggggtcgcctgtggtccctgcgtgaagaaccagagctgcctccgctttgtagcagcctttgtgacagggcggttcgatggccgagaagggagcatcccggggaaccctgcggcggctgtggtcactgcccaggaggcgccggggaactgcagggcgctcgaggccaggtgagatacaatggggtcgcagggcatgggggcaggtgctgtgtcccctctgcaggtgtcctctctgcgggcaggtgcctccctggggtatttctctcaccacttgaccagcaaaaacctgtgcagctcggagacttcttaaaaaggtagagataactgctgagcatcccactccaggtctgtgggtccagttttctttgttcatctctgggtcggccctgtcctgcagttctggaacctgggcttacgaatttccgctccgattggaaagacgagtggactcaaagcgagggaagcggcagtggtgggtttaatgaggctccccgggcacacgcggtctgtgggcaggtgggtgtcctttgcatcacaagaggtgtgttttgggtgggatgagggtgcagagctgtcacaggcgtggcccaggccaggtggaccaagaatgccattcaggaacagcacgtttgctcggcctgatggaacagcctaaactctcacaagtcacagccagtgcttttgttcacttcagaggagcaagggcattctgctggcttgagggggagaaaggagcttgttgctgatttccgctccatcctgccctttcccctgtctggcgacctggaaccacggtgggctgtggaacgtggggcagaagttggctggggccagcccccacccctgctttgacttggctccccacggagtttgggagcatttatttcagagatggatgggcggcggctgggcattggcaggtgggcgtcagggagaggaaagggaggcagcgaacacatccaggcgatgcctgactgtcctggggctgagcggcgccagccaggagggccaccatgcgcaggagagcctctcaggctgccgccttcccctttcccccgccttcccctttcccccgccttgggcacggacagagcctgtaacactgaggagggctgtgtcactcactgccggtcagctgagcgtgcaccgtgtgggtgcaagtaccccagggctaaaataacagatcccagcctccctccgagtccactgacatccaccacagcaccgtgtgagggaggcagccaggggctgtgcgtgaatcccgcacacgccagggtgtccagcgctccattcacgccccaccaccctcccaaagctgaagtcttaagaccctggacatgagcacagtgggggcttggagatggggaccccaacacatccccttcctgtgcactggggaccctgatacgtccccttcctgtgcactggggactctgacacgtccctttcctgtgcactggggaccctgacatgtccccttcctgtgcactggggaccccgacacgtcccttcctgtgcactggggaccccaagacgtcccttcctgtgcactggagaccctgacatgtccccttcctgcgcactggggaccccgacacgtccccttcctgtgcctgagaactcctgagacatcccctcactgtacataaggacccccaagatgtctccacaccatggggtaccaccctgttccttgtgggagcaggagaatgcaggagctacagtgaacttgtccctgtaactctcacagcgacagggcctctctgcggtggcagtgttgggagacgcgatgagagtgtcatccgctgtgagttctgcggtgctctggtcccccgtgaagacatcgtccacgacattcacactcactgagccacgtcctgcccttggctggaatgtgagggcggtgagacacccccatcctgtaaggaagtgtgcaccgagccctggtccccagatgcaccgagcccgtggcatctgggtggagcggcctccgcggcacagatcacctgggtgtagtgagaggcagactctgggtccctgggcctgcgagcctgagaccggatgaccaccagctcctggcagggtccacaccccgaggcacaggcagggggacgcatagcccaggtgtgggacctcctccttcaggccgggcggtgcgggtgcggctcagagcccagtgccctctgcctcctgttgcctgggccgccagcgtgacccacctggcatggacgcctggggactgagccttgtccggccccctcccagccctggctgtctccctcggcaggagctcggcaccccgcaggttttcttcccaggatgtgcgtctccgattggaaggtggaggagtcacagatgcccctttgtgtttccaggcctggactgggcaggccccggtcagggctgggggaagatgctcagctcatgttggacctgaaggttgtgggaaactaggcccggagtgcagcagtggaggccttgtctgaggggtcgggcagtgggggccccagcagagagcatggggccgacgagggggacaaagggacaagagctcaggagctttggaaagaggtctaggggcctagtgggctccaaggagggcagagaagccccacgtactcctagtaatggaggccgtgcccacctcgtgaaggggatttctgagctggggccgaaggcacaggatgtggtggcgtaggaagagcagtgatggaggctttctccaagatgttggccgtgccgtggagaggactggacgctgggccaagggtggccgcatccatggggcctggagcctgcggactgcaggaagccacagagtgggtggcagcaggggacctagggatggagcgagcccaggctccgtggcaggtggccgggggcatctccccaaggctctgcccctctgcccatcaggtgggaggtgcggcagatggggagtctggggggcctcctgcggaggagggtgtgcgccacggaaggctgctgagccctcattgtgtctggtgggaggcgggcgtcacagctgtgccgagaggcctgctctcgcgtgctgtgggaggggggagacgtggtgagggagagctgggcagggaccatgccgcttaccctcaggacagggtgagctgtcccagcagtggctgagcccgtgctgcataagggacttggcgtgatgtctgtgatcgtgtctgtggttggaagtgacgtctgggctggagctgacacccagctggagctgtgacaaaggacaggatgatcagggaaattgcagagaacaagggcgaggatggaagcttgaggggcgccgaggtgtggagggggtgtcggtggaagaaccctcaggagctgggctggggctggggctggggcgcagctcgtccccgagtccatggtggtgacgctcaggaggcgctggttccagtggggaggttggggaaagcacttcctgatgcctttgggtgtggaaagtggtgggggcagccaggctggttcagtgcaaggcctgaggtgaggttcaggtgcggcccacgggctgtggcagggacgcagcactcagcaggtgcctcagggtttgttggaggtgagggggtagcagagcccctcacacaggtctaggttgcaggttcatggcagctgggtagggacgggaagctccagtaagattcaccatgggatttttcaccagaaactcctagaagttagttctgtgtcgtgagaataaaaaagttaacatgtctttggcttcccatctgctggggagtgtgcccagtggcactgcggaaacccaggccggacctcacaattgcaggatgagcctcctcccttctatccggcaggtggccttctccaggcattgccctgcacctcgaggggcagcggggcttaagtcaagctctgtaaatgcggcacccgacgtctgaggcccgccacgctgcaggttcccatctccaaagcccgtggtgctgggcacggcagagccgtaggcggagacagggagccgggaggagcgtcagatgcctgtggcctctttacagctctgtcccctgccttatctcgctggctctgcccttggtcatcaggatgtgaggcggtgacggacacttcagtgctctgacgcactgtggccccggggaagcgtggtgtctgcagcctcctgggccttcccttctgcctggcttcctcctcctccacccgtccacctgtgtgtctgggtcaggctggcttctgcatctctgtggacagacctctccccgtgctgcagctgttttccttgggttgagcactgaaaagagcccctttgggttaggaggcaggtggacttccactcacatggaggaggagcctcctctgcccggaggagacggtgctgggagaaaatgtagctgcaggtggagattttctgataaccaagagtggatgttgtctgtttactgagtggaggttggggccggtgccagggttgtccatctcccctctgtcctgcatggcatggtggcagagataccaccatacttcagaggcagcagcaccctcgccgggtgccggatctcccagggtccacctgtgctgccctgccctggggtatttggagctgagttccaattaagccaagaaaaacagattgttttacttagaatttagaaattctcctttttttttttttgagatggagtctcgctctgtcacccaggctggagtgcaatggtgtgatcttggctcactgcaaccctgcctcctgggttcaagcgattctcctgcctcagcctcccgagtagctggaattacgggtatgtgccaccgcacctggctaatttttttggtatttttagtagagatggagtttcgccatgttggccaggctggtctcaaacttctgaccttatgtgatccgcccgcctcagcctcccaaagtgctgggattacaggcatgagccattgcgcccggcctagaaattctcttcataaaacgtgtttgagattggcacaggaagtttcaaacagaatcaggattcaccataagaagcagataaatacatttgaggcacccagggtgagtgatctcagcggaattcccctttaagcttcctagtagcgcgtgcaaaaaggaaaacgtgtggatctaagactgtgcacaaacaaaagctgttcttctgggaggaaccaatccctcagcaatcacacttgactccctcgaaggaaagctggaaggggagagggcgtcaggatgcaggtcccggtgtctctgtgcagctcatcctccttcagaggccgctctgcttctgtccatccctccaattgccagtggtgtcagcatttggggccgtgatcagatggaggaagactggcaagcagtcacccccgacaggactctctggctcagcctccccaggaatatgctgctccccaggcacagcggaagacctgctgcgtttcatcttccggctgcctgtttaaagcaagggaggccatgcccccagcggggtcccttgtgcctggacccaaggcaagaatagctcaggcttgttcctttttcctcaagttcctctcgggcgggcacggtgtgtcgcctggacctgcatgtaaacatcagggcggagcaggaatcggcctccaggagggtaattgcctggcgtactctgtcccaggtagtgggtgaaatgaaagtaaaaagccagctggtccctcatgcagattttaggggacaaagttcagcatagaaaggtcctgttacaaggagagggttgtggcgagcccagggcagcgcgcgtcctccccggcagctgatcctcgccatgggggacggaaaggctgtccggatttccgtggcggaaatgaaaagctactacctgtattctgagtggtgctcctggctgctgtccgtggctgagggtgagtctcctcgtcccctgtgagtccctcgcaggtggtgtgctcggagcagtcgaggcggcctctgggtgaggcagcatggaggtgccctctgtggatgccccgtgctccacagggcagtctgtgtcccctgtggaatttgcagtagctcagggagtggggatgagaagcaaatgagcttttcaccctaaagttatcatctgatcctaatttatgtcacagttaccaaaagcaaataacctccttttgtctggcaagcctgagcctcacaaactgtgcaaacagctgggggctcagcctgcaccaggctgccccgcgtcttgagagctctgatgtcccggggccatggctgcaggtgcaggacagagacaaggccgtgaccgaacactttgctggtccccttgaccatgggacacccggtgacgtgcctgaggatcggccccggcacaccgaagcccggtttatgcagagcttcccacggtcagccgtgcagggagctgtgagccccggccactcttcctcttcccgtcccgtggtcagtgagcccccagggccgtgcgtggggctgagcaggtctcctgcctcagaaggcatttccttcattccacctcgaaatccagaaaatgccctggaacaagggctcgccccttcactggctgaatgccatctgtgtgtctgcctggcatgacctgcggtcggggtctgatcctgcctgtgaagacacagtctctgtgaggatggggccgcggccggatgccatgtggcgctttcccggggcccagagtgctgagtccttgtcctcagagttgcagctttgctgtttataaaactgcatccactctcttctgaactcacccgttctgcagatgaggagagtcaggaagtcacggagagaaatgcgcatcacagggttgtcagagcgtcccacgaacggtgtgggaggacacagcagtagacgtcagcaccaccaccgccccattcacacctgggcttcccccaaacctcccacctccccacggtcccactgccctcggaggacccaccgcacaggggtgtttaagacagtggcggtgctcccgggagaccacggggtgtctctgaggacaggcggtcccctgggccccctggttaggacagaaacgcaagagccacgcaaacctctctgtgacactggggaccccctgagggagggaagccccatcggagggtctgctgggcgggcctgcctgcctgtgggtggacactgggccgagggtgccaaccctgcccacggggcctcagtcctgcagccgggtctgcactgcgccctcactcccctgcctgcctcacagaccgtgggggctcccccaacagtggcgcgtacgctgcactctgccagggccgtctagggttctctcaggactgtggggatgcctcaagggtggcaggagccacttttggccaatatgcagttagatttgataagaaaacaagctggcgtcctgcccaaggctccggggaggtttcaggtgggactcggagccagtgtcggagctggagcacatgaggtcgcggggccacagccaccctgggctgccgcatttccatctcggtgggtccttttacacagatggcacccggtgaactcactcagtggagctgcctttccctgaagccattccttcacccggctgcagggccgcagacagcacgggccgcagggtctctgcagcttgttcaggttcagattggatggggtcccagaaggcatctccctccacctgccccttccagcgctttcccgaaacgctgttgtctgcagccacgcagagggtggcgtgcgcctggagcacaccttgtggacgcagcccagggctcgttgtctgccccctgatccacccagcacaaggtcagcaccagcacccattggtctttttcctctcttgcttttcactcactgctcacactcccttcctcagacaaattaaaaccaagtcggagaggcccagcaggggaagcagagttggccttctgcagccgcacagttgagtcctggagttcagagattttagctgctctgcccaaaacggtctggcagactaaggaggaggccgggtgtgaggtctcggcctgcgctgcatgcaacgttttcacttccatggtagtggcagaggaaagggaagtcctccatactgtggcttgctggtctttgcacggtggtgagagggttgggcgttgggctccctcgcccccatccggcctctcatccctgtccagggcctggaaggggccagtgtgtgtctggaaagtgtgaagtctggcaggggtgtgggaagtacccatgagcaccatcgctgtgggcggacagtgatgggattgtccccctcgtcacagcggacctgtgagaaatgaccagaactgaccctgcccagcccacaaggggacagcctcatccaagcaacacacacccattgtcacagttacttggaatcctgctctatatttttgttcttcagagaaggggaaaagggctgggcatcagaagattgctctgaataaacagtgtgtttagaagagagtcacagggtcaggctgcggggcgaggaggcctccttctggaggtgcacatgccactcgtcttggggctgagaccaggagtttgcaccgattcagagggaagtcgacggcatctgtggcagcgcacatgtacacaccgtgtgtggtggtgcagctgcctctgcccgggatgcatgatgctctctgtggtcctcgtctactgtgttttttttttttaattctacatggtgagccaaaaaggttgttaagcacctttggggtacagccctgccatgataagaatgtatttctaaaatagtggaaaggaaagtcgtggagaaggccagcacctgcccggtgtggggagcagggcccgggcacgtgaacctttccctgcggagctggtgcctgtgggtgcacgggtgtggtgcgttttaattctcggcagctctgtgcggcctggagggacgttctgtcctgagcaggggatggagctaccacacccgagtcctccctgagcaggggatggagctaccacacccgagtcctccctgagcaggggatgggctacgacactggagtcctccctgagcaggggatggagctaccacaccggagtcctccctgagcaggggatggagctaccatgcccgagtcctccctgagcaggggatggagctatgacaccggagtcctccctgagcaggggatggagctaccacacccgagtcctccctgagcaggggatggagctaccatgcccgagtcctccctgagcaggggatgggctacgacactggagtcctccctgagcaggggatggagctaccacgcccaagtcctccctgagcaggggatggagctaccacgcccgagtcctccctgagcaggacatggagctaccacgcccgagtcctccctgagcaggacatggagctatcacgcctgagtcctccctgagcaggggatggaactaccacacccgagtcctccctgagcaggacatggagctaccacgcccaagtcctccctgagcaggacatggagctaccacgcccgagtcctccctgagcaggggatggagctaccacaccggagtcctccctgagcaggggatggagctaccacaccggagtcctccctgagcaggggatggagctaccacaccggagtcctccctgagcaggggatggagctaccacaccggagtcctccctgagcaggagatggagctaccacgcccgagtcctccctgagcaggacatggagctaccacgcccgagtcctccctgagcaggggatggaactaccacgcccgagtcctccctgagcaggacatggagctaccacgccagagtcctccctgagcaggggatggagctaccacgcccgagtcctccctgagcaggacatggagctaccacgcccgagtcctccctgagcaggacatggagccaccacgcccgagtcctccctgagcaggggatggagctaccacaccggagtcctccctgagcaggggatggagctaccacactggagtcctccctgagcaggacatggagctaccacgcccgagtcctccctgagcaggacatggagctaccacgcccgagtcctccctgagcaggggatggaactaccacacccgagtcctccctgagcaggacatggagctaccacacccgagtcctccctgagcaggggatggagctaccacgcctgagtccttcctgagctcttagactccatgcgagttcagtgatgctttcttttctaatttgccaatctcttaaaccagcagtccccaatctttctggcaccggggaccagtttcatggaagataacttttccacagatcaggggtagggatggtttcagggtgaaacggttcacctcagatcatcaggcattagattctcataaggagctcacagcctagatccctcgcatgcacagttcaccataggttcgctcctaggagaatcaaacgccactgctgatctgacaggaggcggagctcaggcagtcctcactcacccgccactcacctcctgcttaccccctgttcactcacctgccgctcacttcctgctgtgcagcccgaccagtaccggtctgtggctcggggcttgcagacccctgtgttaaaccattcagatctgtgggaaccttgtctatcctgaaagtgcaggaactaccacacccttcgtcactttcttatgtttaaagacccctggaacttacagaatgtggtggctacaccaggtccagccctgtcgtgggatatttgttccaaaccctgcagtgtcaggtaagttcggggacaggagaccactttgtcttcaccccagagaagcctgtttttcaaggacaaagtaaagagtgtgctaagcaaacccagtgcaagtgcttatcccacatacggtgccttgagaagtgtgacataataaaccacccggtggccgaggcggggagcagtggctggcagagaccctcgcacagtttccttcagaatcacatggaggggtctgctcttgcaaggagacctttgctttccatgattgccaagagcagttcagaggactttccacgacttctatgtacaggcacgaattttcagaaaaccaaactgctttctgtgtggagctaagaacaaatgaattagcagaagatgacaaaggtcccaggggtgcttttcttcatcccgtccttcttcacttacttgggaagtgtgtgcccagcgtctgctctgtgccaggccaggccaggcccaatgctgcagggaaagcaaagaatcagtccctgttccctaaacaacgggcagggatgacctggggtaaggagaactggcgtgcttatcagctttgaggagagcgcagctggctgaatgcgctcctgaaaacccgctgcctcctcccctgagccaccaccctgcagccatgtgacagtaaactaggtgtttgctggtacattgttgccacagagacaaaaacaaagaaagcctgctcggcctccgccacctggctctgcacctggggctctgtacctgggtccagctgctctgtggggcctgcaggaggggacgggacaggagctctccttccaggaagcagtctcagctgaacttgagtgtggccacagcactgccctcactgaggctttctgcgaaatccggccgcctgccacctgcttctgttaactttgtacacgttgtgtgggacctgattcgctgtgttttggggggcatctcccgggacctgatttgctgtgttttggggggcgtctcccaggacctgatttgctgtgttttggggggcatctcccaggacctgattcgctgtgttttggggggcatctcccaggacctgattcgctgtgttttggggggtgtctctgaggacctgattcactgtgttttggggggtgtctctcaggatacgaacacctttcagacacattatccagttacagtactcattccacaaggaaataatagcagatttttaaagtgtgacttcattagaacattggaaattttattagaagttgctaagtatttcaaaaatctatcagaagtttgcaaatgattttataaagacagaccctcaagatgacagctcaggatgcaactgaaatttgcttttttgagtgtatttggcgtttgctgtttgtgaccctgattttcatgctctgcagcagtctgtgctccctggccgggaaagggggtcatttgctcagagccaggagcccttccctgcgggttaagttaccggaagtcatgtctggcagggcaggatttggctggttctggtctcaaccacagccgactccacagggcttggcctatgtgggattcagcccacgaaaacaatttcttgttaaaagcacctgtcttaccctccctagtgatctcactgtatttaaaatatttatttaaacaaggcaagtattccctttttattacaggttgagtgccccaattagaaaatccaaaatgctccaaaacctgaaacttttgagctctgacatgacatcacaggtggaaaatccacacctgacccgacagtcacagtcaaaacttatttcatgcacaaaattaaaacagtgtataaaattaccttcaagctacgtgtatgaggtgtgcgtgaaacataaatgaattttgtgtttagactcgggtcacgtcccaaatgtctcattatgtatatgcacatagtccaaactctgaaaaaaatccaaaatccgaaacatttctggccttaagcattttggatatgggatacccagcctgtaggagatacttggccatgtttagtgggagccaatggatgtatacctaagaatctgcctaaacctcgaccgtgcttcctgatgtcatgaggcccagtcggaatgtgcccgacttccccatctcagtgagggcagtggaaggggaagccgtgctcctgtggggagagccaccacccacccaggtgctccagacgttcccgccgtgcgtctgtggtggccacgtctcatcctcagtggctgcacgtctgttccttgggagtggattagggaaataagcgtggcctgtaggaagctgagtttgaagcagtgagctgggcccactgaataatgatgtggaagcttctcagcccagtctcgtttttgtgaaatggacactgaatattctagctggggaaaggtggaacttggcacttacgtaacttacccttctccccttggtgtttcgtagccaatcatttttattgcattaggtctcctatactgtaaatctacagaacatcgggaacactgaaaagttcacctcagttctggctttaaaagcactgactttcacattatatttgagctaggacaaaagaaaacatttctctgcaatgtgtgttcatctcgtaagggtgtctacactgaggtcagaccctggtgcaaaccccaaaatacttacagtggcagccccggctcagtctctgccaaacgtgcgcgggcatcaggcaggagtccatgggccatgggggtgaggagagagcggctcgctgccttgagaagctcccgcttctgcagtaaggtggcttttaagccagagattaccacgcgctgccgcggagggagaggtagcgcggggcatggggaggccacagagaggctgtactgacagaggctgggggaggatctggtgatggagacacgatggcacagccccggtgaagccacgtgatgtcttcgtgtgaacatggtggcgggggagcgccgggcacacaacatggtgggtgttcctgggcagaggcttggtgggcagtaggggccgacctgagggctctggggtcaacaccggtccaggaatttgactgttagccacagagaccgccaggagggcttttaggagatatgtgaaatgagactcagctttcagcaaggaaatcagggagcaggtggcagtcgggagggactgcatggaaacaagtggcttaggaccaccctagtcgttcaggcgtgggatgaggctccaggatcgcagccacagaagtggcagtgggaggggagggggagggtgcctggagagaggtttcagggcaggagggacggggcttagggatgtttcttggagagagggagcgagaagtcatcgtcaatggccccacgatgtcaggcttggaatttggggtggacggtggtgccatcagtcaagagagacttcagagggagaggttaggtgatcccatcccattttagcaccagaagtggctgtgtgagctgggaatggggtcctgggtgaagatgacaccacagataccttggagatctgcctccagttaagagacgtgtttgcctcctgggtgggtaggattttcccctcccttagatcggaaggcgaagaaggtgagatccacagctcgatttcccttcagataaaaggcacaatcacaacagcagcaaacacaccttcattttaaagacagcagaggaggggtggggtgggagggcagtacccaggacagggtcccagccgaccctccgccttcgtctttttcctgattaaaaaaaagcaccttcatgcggggtgcggcgcttgggaccccccaagctgacgtcactgtctgtgccggtgtctcgggcaggggcaggtgtggatgccaagctgacgtcactgtgccagtgtctcgggcaggggcgtggctgccaacggggcacggtgcgtgggatgccaagctgacatcactatgcaggtgtctcgggcaggggctggcgtggctgtcggcgtgacggggcgcggcgcgtgggacgccaagctgacgtcactgtctgtgccggtgtctcgggcgggggccagtgtggctgccaatggggcaaggtgcgtgggacgtcaagctgacgtcactgtctgtgccagtgtctcgggcaggggctggcagggctgcccaggaggctgtcggtggggcagttcctcatgaatctctgagctgagtttgtaaaagtgtgtgagagtggggaaaatatgggtgaaaatattttcagacatttggattcccctttggtgagctgtctcgtttcttcccgctggtcagggatgtggctgcttgaacagctgggcgcggtgaccaatgtgtggagagccgggaagcctgcggtgaggccgcgcgatgtccttcatcccgggcagtaaatccagccccgagggtggggcatcctcccgggcacaggctctcctgcctggggtcgccgctgcgggcaggacatatgggcctcccaagcggtcccatctacacaggtcgggtagagtgagtcggaaaggccaccgaggttgggggctgcgcagccagtgggctgggctcaaacccaggcctgcgcttcccctgtgagcccaggcagccctcgacctgtgtgtggctcggttttatcgcccaaaaaggggaacaacgcctgcgtccgtgtgcaccgggctgcggagacttccccaggtttggctccaggacggtccccaggggcgcctccctccatcccctcctgtcctgtcacctttctgcacacggtgtcgcatcctctgacctgcgtggcactcacgtgtgtctgcccctcccgtgttctcctctccaggatgcggctgtttggtggcactccgctgtgtcgaggcactgtgcccgtgccccgggctcccctcgttttacagactcgctcacggaggctcagggcgtctctgagggcacgaagctcatgtcagccagcagaatggggatgtagaccggggctcgctctcgagcctgtccgcctcctgaacatgcctgtttgctgagcatatgattaagagaaagaaggaaagagggtccatttgagagcttagggcagcgcccagtataccgtcagcactaagctgtatgagagcttagggcagcatccagtatacagttgtgcttagtacgtgttggcactgcaactgctgtccttgccgctgtgtgagctgctgctgggtggcagtgtctcagggctgccacttctgccccaggagagcagaggggagctggcggccgaggtggggtcggtggtggggtgagcctgcggcgttgtggctccaaggcctgctggcctgaagtcacccccgggatgtgccccgtgtgggaccgtgcgggatgcagggaggagcgtggctctgggtgtggaggtggcgggctgctggcatcctgtcaccgaaccctccttccacaggaacgggggaatgagtgggagagcagtgggagagtgtgccctctcccccagactcctctctccctgtggcatgagaagggtgggatctggcttaccaggtgagtgagcaggcgtggcccggaagtccgttcagtcctgggcgcacccacaggaactgacatccgcatgccaagcagcacctggcggccaccggggagtgatgccgggtgcagcctttacattcatcccaagcacagtacagccctgccctcaccccatgccaggctgactttcaccagatccaagcctgacgtcttctctccacatagtcccgagttcccctcccagggccccatttagagacctccccttttcccgaagccaccagactcatgcagtctccaaggctgggctagccctcgtcatcttctaaggttatcctacatcacaaaggtaaatggcatttaaaataaaatgtaggccaggcttggaggcgtgcacctgtaaccccaggagactaaggcgggaggaccacttgagctccggagatcaaggctgcagtgagccgagatcgcattattccactccagcctgggtgacagagcgaggccttggctagaaaaaataaataaaaggcgttgactttagagagtttctgacaaaagaatggaaatgtttctggtccctgcatctagccagctgtagtgaccccgacacgccaggatgggccgtgctaccctgggctatgtgtgcagcggggctgggacgggccaggctcgacctgtgctgtgattttccacccagaacgtcgcaaatgtttcccaccatgtggaacgtctgttggggaaatggtgttccagagtgtgcagtgcccttcagaggccctgcgtctccatcttttctccacggcatcctgcgaccgtgctcctcaggtgtgccccacgggcccgggaatgtccttcttggatgcgcccgatggtcccgagactgtcgtcctcagatgggttcatggcccaggatggcatccaggctcctggtgagccctgtgggtggagacctggtgccgcccctcctctctcctgagtcctgatggctggcagtgccgcccacggcacctggacgggggctgtgttgtgttgtctgcatctgtgcacagctgagcccctgcctaggatcctcagctgctttctctggcttcaccacccccatgaaactcctgcacagatctggacgcaccctggcagctgctgggccagtcccgccctcgctatctcaggtgtggccgggcagctgtgggagctgggcctaggcgggtgctgctgccagccccgggccgccctcgcctgcactgctttcccagctgagcggctgcttcccgtgaacggagggactctgagatcatctcgtcctcacgtctccatctggggagagcaacttcccagctcagtggcagacccagagccccaaattcccatcgagagcctcgggtgagtcttgagaccaagaccactgtgggtctggcccaggaaaacacactgccctctctctgctgcactgaacccaggcagcagatgccatctgcgcttccaggtttgcgatggggttgctgctgacgcccctgtgcagggtgggagccgaggagctggcagacagactctcagagcagtgttacacaggcagctcctgcagacacctgtgtagacatccacgtcacccatagctgggaccccgtacgtggacagcagagtggggggcatgggtgtcactgacctttgccccgtgtccactgtcccttcagccccagccacctggtgagccgcgccctctgcatctgctgctacagaggtgttttatttgacttaaggtttagctgtttgctttggcagcaggtcccaccccacagcctgatggctccagacagggctgaccaggtttgtaaaatgaaattgtccatccgggaggaggagaaagcaaccccccatccaggtcggtcaccccaccctcgtccgtcacacctggtgccatcactcccacagctccttggggtgggaagcgatgggtcgagttcctgctggacacgggcctcaggccccccgggtgtccccaaggtgcagggaccagcgtggtgacgctcattgttcagagctgctgatctggggctggcgtgtgtggtttcctctccaggcagggagcaccttcctgtttaactgattgggacagggcaggagtgggctcttggctgaggtgctgggcctgcccgcagcagcagctgtatgaagccggtgcgtcggctctgtgccctgcgtgagcccatgtgtgcggggcctttgtgttgcacttcactgagggccccggggtccactgggcacctgctgggctcaaactgcagtgcctgggccactttccatcctgtgttccgaaccccgtgcacagcgcagctcctagacacggtcattcatgtaatttctaggcacatttgtaaagcacaacacacaaataaaaggtaagggccaaataaagcacgaagtctcctcactgctgttcttgggaaggcagaacttaaacgtgtgaaaaagctggaaaacagcataccaaatacaacaactagaaacccagggccctggcatgtcagggaagggggagctcagagccaggccaagcgtgaggaggccgtgagccacaggcctggccggggctgttggggaaatgggctggggacatttctggagggttccggagggtcctggaggcctcaccaaggaggctggagtgattggttacattattcatggagctgactgggctcccaggacgggtctgaaatcacaccaaagggaagcctgcaagaaatcacaagaaatgtgctttcctgggggatgggatggtcgtgtgttcaaaatgtgtgtccctggggaacggctgtgtgtctggcatcgacttggcctggacttggcttctctactgcgctcccgatcccaggtgtggggtcgattctgtcttgcgccgattggaggcctctgctgtgggtgtggtttcacgtgcactgtctctggctaaaggtctaggtgcttggaacagcttttatgaatcggaaactggacagaaaccagcctgaggccgtgcgagctcccacggcccttggaggaaagctgtttcccatctccagccagagaagctgcagggatgcctttggccttgacttggtcagcagggagctggaagggtcaagagctgtgggtggggagccctcagtctcctggactgagtgagaaacggtgggtgagcagccatggccacagcgatgagcccgggatggtttcccgtgtgtggttcgggccacgtgttccggcctctgatgggcattactgtggccccccagggacacagagcagggccagccctccctggcacagggccattgtgagccagtccctcctgaagatggccaggtcctccccggcttggggccagaccgcctgggtctgccctatggtgactgttgcgtggcccccttgcttgttgagcaaatccatgagactccactgtgtaccctgaaggagcacagcctttgcccaccagaaacttcagtgtgacaagacatcgggggccaggagagacgcacagaagaggggagcagctgatttctcggggtccttgcatctgtaccaggggcccctccttccccacacgacgccctctccttagaggacagcctctggcaccgctcactcactgtccctctgtttaaaaactgaggcccttctgtgagagcctcctgctcagaacacagtcctctttttcggctgatctttgctcactccatctgcatcagccgctgtacggctggctgcctgagacgtcccagccctccgtgtcctccagtgctgggagcaccgagggaggaggtgggccttgggcctcgggggtctctgcaggccttgagcacattgtgggagagggggtgtttggtacatgtgtcccaagcctgaggcctctgggcgtgctttgctgttgggggttggaagctggaggtgaggacacgttggactgtgctcagctgtgaggggacccaccgtgtggcaccgtgatctgctcctgtgcccctgccgcctgataatgtaggagttgtgcctgcaaaacatgcttcggacattagagtcggctgggaatgaagatgcctgcaggccccagagcacaggcagggctgaagtgcgggcggcgagtgggctgggaatgaagacaccggagggccccagagtggaggcagggctgaggcacaggtggcgagtgggccgggaatgaagacgccggcaggccccagagtggaggcagggctgaggtgcaggtggcaggtgcatcggctggtgccgtggtgacggcgtgaggggccatgatgccgtggcctcccccggggctcgtgttccagggatagctcatctgggatgcgttctgacggtagaagataggaacacagagatcccagacacaggaggtctgggtcaatgtgcacagcccaaacctgctgtggctcagggggcagctcacaccgtgggtaccagccagccctaggtccaaacttacagggaaggatggctgggctggggaggacaaataattatggatggacatcacagcccctcggtggtcgtgagtgggtgcagaggggcttgcagaagcgacattcctgccccagggatgaggctgcctctcagaggacccaggcgtggaggaagcagtggcccctcttaggcatccctcccctaagtgtgtgcagcgtggagatgagagtcttggcccaggaggaagagtgagcttccagacttagctttggtgcttgtcagcgcaatcatggctgcaagaaaagcctccatggctgatgttcccagaggcagggcctggcgaggccacgctttcctctccagcaagcgtttggacctgagggagccgaggtttccagaggcaggagccaggtgtctggcatttggggtcagccacccccagaagccggtgttcccagcgggagaagctgaagcctggagggctggctgtgctgtgctgggcacacgcagggcaggagtcagtgcacatgtaaggctctgcggagaaaggcgccggaagaggccggggccagcagggacatagcaggccggggtcccacccaaacccagcacccctcccaggccttctcggctggggctgactccagcagtgggtgtgatattctcaggagatgtgcgttgactccagcactgggtgtgatattctcaggagatgtgcgttggtccccttagctccttgggattttcggctcaaactctgggcctggacaaatggtctcaggtaacttgggagctcgtcagggacagaacctgagtttgaacgagctctctgtgggactcccacccagggcagcggttaggagccccctcctggactgccagttttcaagtgacgtatttaagtatccccctcccggtcctggaaaagtagagaggcagccgggagcctgccttctgtgttctcggtgcaggggtattctgagaacggcccctgctcacacgggtttaaaaggaactcagtgaccacagacggatgagaacagcggacgcagctgcctcccaggcactcaaaggctcaactccccacaggcgtgtgttgccaggggcagaaggcttggcccctgggtcagcatactctccggacagctcatccctgccagcccaggtccctgcagccctggggctagcacaggggatgcggacctcggcctaggtccccacagctgtggggctggctcgggggacggatctctgctaagcatggcccctgccagctcaggtccctgccactcagtggatgggactttggcggagtgtggggcccctgcagggagggtctagacaagcaacaccaggaacctgaagcctccctggccggggctcagctgtcgccaggatcgcaacagttaagctgcctgcagcaggataagtgagccgatgctgctccttaatcagggacatcgaatcggaggccctgggaggagcagccggctggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcactgggcagcatgacggtgcgccggctgtcactgctgtgccgggacctctgggcgctgtggctgctgctgaaggccggcgcaggtgcgtggggcgcgggcgggtcctcgcctccccggaaggtgttgtggggcgacagtgcggggacgccgggcgggggtggacgttctgggcccagccctgtcctcagaggctgctggggcagaagcccggggctgggggatgccggggatggatgttggggtgggtgcctccgagaccagaggagccctgttccttggcagggaaggtgtgcacgggccttgcccgatggatggtttagggccatggccctggggtccctggtgagcagtggggccgcctctgcccttggcctgtgagggactgtctgtgctggtcccagaaggctgggatcacctttccactggctcctttgttcgaggtttttcatagacaggctatgtggacaaatgagggcagcgcccacgtctggctggtggaggggctgcggctcctccttggaggggacgcctggccactgctgtccccacaatggggccacccgtggtgcaaggcgtgacaagctgccctctctaggtaagcaggacttgggaggcccctggccaagcctgtggacccggctgggcggcctctgtggtctcaggtttgggtgtgtttggtctggtcagggctcaggggctgctggtccacactggccccatcctgacaattggagctttggggcaaggtccctggagaaggggtcacgtggggaggaaacagcctgggttttgttgatgcttttctaagaatggagtactcgttttcaagagatttgtcctaattatattttccagcgggtacttatgccaagtattgatgaataattcataaaataagcatctttgtgaattttagtgaatcagaccttaactatcaacggcaatgaatgaacatctaaagtttccaattttaaagtaaagaactggctgggtacagcagttcacgcctgtaatcccagcactttgggaggccaaggctagaggatcgcttgagcccaggagtttgagatcagcctgggcaacataccaagacctcatctgttaaaaaaaaaaaaaaaaaattaataggctgggtgtggtggcgtgtgcctgtagtcccagccacctggggggctgagaggggagaatcatttgagcccaggaggtcaaggctacaataaggtatgattgcacaactgtactctagcctgggtgagggcgtgagcaggtgcaggtggccaccccaggttatggggttggctgtggagcactggggaaggctccagggtaagcaggggtaggtggcccccgtgggttttggggttggctttggggcaccatggaaggcttcggggtgagtaggggcaggtggccccctgggttatggggttggctgtggagtaccgtggaaggctttggggtgagtaggggcaggtgaccccctgggttatggggttggctgtggagcaccgtggaaggctctgggttgagtaggggcaggtggccccctgggttttggggttggctgtggggcaccgtggaaggctccggtgtgagcaggggtaggtggctgctttaagagaggttgtgtcccctgggtgccccctggttttgcacccctgaagccctggccaccccatcctgcagttccctcctgaaggaccaggcaaagccaggaccaccctggacaagaggaggaattgtccttctgagccctgacggttccgtgatcagacccgggacctgctccaggctctgttttagtgtctcacgtcctcttagggtacattgaagaagcattgtcggtgccagggtcagccagggtcagccaggcctgtgttcctcactgtgcccctcctcactcctgcagaggcctagggacctggaaggaacttgccacctgtgggtgacctttctcagaaggtaaaatgcagggtggggcgagccccactggccttggagagtctgtcctcgggcccagagggtgccagttgggggaggcgcagaaggactgagacacttggattccacagagaggtcaccgtggtacagtccagactgttgtttttaattttaaaggaaagaatttgttatgacgactgttctcattctcctttaggcatttttaacatgtgttccaggcagaccaggctgtggcccttccctcgtggctggtgcaggccacgcctccccccggcccagcgagtagggaggtttggctctggcatgaccctccggggcacaagtgtcctcggggagctggtccctactacatagaggccacctggcgtcacttggcagaggaggacggggcaccaccctgcagagaagcgtccatctgcccgtcagtgtgcggccacacttggtggtcctcttcaccttggcctcttgttgagcgcacctcccacctgcacagcatcctgcgtcgtagccaacaccacctcctccatggacctcagtctgcagccgtcactccatgtctgcagctggggccctggccagcccccatggcgcagtgctggggggttcctctgggtccctgtagcctccataacataacctgggagcaggaagatccccctgggtctgctcacctggtggggggcagccatcaccaaagccgtctgcctgcatcaccggctgaattgcagccatgatcccacaaggaagccttgtctcagctttacagaggaggaggaggcccagagagagaaagcaactgcccagagtcacacagctcagggaggttgtgttcagggtgaggtctgtgctcccgcagggccagtgagtgtctttcctgtggcagccgctggcccacgtgtgtggtgatgacaccaagcacacggaccacgcgtgtgttcagatgctgcctgggcttcacgttggtgcccatttctctctggaccttacgaagacaagtttgcggaggcatggcagcccgtgcatgctgttggtgggcacgtaagttggtgcaggtatcacggaaaacagtgtggggtatggaggttcctcaagtaattgaaaagagcactgtcgttggagccaggagtccccactgtgggtgggtatcggggaaaggagtgagcgtgttaaagagccacccgccctccagagctcaccagcccacacgtggaatcgaccccagtggccgttagtggatgggcgcgtgaagatgatgtggggcacacacaatagagtgctgctgggtctttgttagaaaggaaagcctgtcattcgagacagcacggatgagcctggaggacagtgctgagcaaaatcagccacaggcaaagccacggcctgctgagtaaaaccagctgcaggcacagaaaggcaaagccacggccccactcgtgtggggtgtcagagacgccgacaagcacggtggctactgggggctggggtggggaagcctggggagatgctggccggaggacacagagtttccgttgtgccaaatgaatgaagtctgggggtctgttcgtggtgggccatggactattcgtggtgactgactgtggtctgtttgtggtggccgtggcgtgtttgttgtggccatggttggtttgtggtggccgtggtctgtttgtggtggccgtggttggttctgggtggctgtggtctgtttgtggtggccgtggtctgtttgtggtgaccatggttggttctgggtggctgtggtcagttcatggtggctgtgacctgttcaaggtggccgtggcctgtttgtggtgactgtggttaacgctgtatttgtacctgaggtttgctgggagtggatgttgggtattctaactgtaaaaggaaatggcagctgtgggaggtgacagtcagtcaccagtgagtttggtggtggctatggtttcacaacgtgaactatatcaaaacagcacgtgtgcgccttaaatacatacaattatttttctcaatatagctggaaaaaatagccagaagctgtaagctcaggaagtgatgagccagccaagggctccgttcacaacaccctgcacagtgaacagagctgagtaaatggggctgcttagcgaaaatcatcggactcgaagctccctgatggctccaacatcttccgtgactctgggcaactcctgtgcaatgggaggccgtgccctgccatgtccccgccttcctgcccacaagcctgccctgtcccagccactggggtctcactcacccatcagcctggaaacagacgcatgtcggcaccctcccagcccctctgcgagagcctctccatagcctcgctgttgagcccgtggcagtgaaggtcccaggcgctggagcagacggcgtgggctcagtcctggcactgcctgccctgcagtcctgggctgcttacagctgagcctgaccttgaattccccgtctttaaaacaaggatgatgaggcttcatgctccctaggtcctcgcgaggactcactcaatgcactggagccaggtgtgagtaggaaacctgcctttctggcctgatcctccccccgggagcacagggtggtcctcatctgaaccccgagggggtctccctggcatgccctttctccctggacccctagccattccaggtgcagctgccagtgcgacccctcctgcggacaggaggtccatgtgagggctcagctgcctctgaaccggaaaggcgctggcaggcagtggctgggagagcaggcgcaccctgggcggcctccaggagagaaagggagacgtgtgcatctcagtgggggctggcgggagacactaaggtgttgaagaccctcgggtctgggccctgtggaaatgctccctgcgggtgccaccagccctgcccactcagcagtcacttgagaacgccccgagcatctggcccaggaggctcggcctggagcctcacatgtgcggaggtttggctcagcccccaagggcaggcccaggtctgtggcggggtgtggggaggcagcggagccatgggtactgtgtagcgggtagggctgtgaccggaggtggcaaagccggcagccagcccggcccttgggggagagggtggcagggtcagggtctctgaactctggaaggaacctgcgtccctcatcctgaaacccggcctcctgtgtctctcagacagtggctctcagtcactttggtctctggtccctctgccccttgattttttaagttgttctagctcagaagccattgtgtgtatggtgtgactacaccccagccagggcatgagtgcacacagatccagggtccgtgcagagcccgccaggtgtagggtggatgctgaggcccacctggctgaaactgcactcaggccattttactgatgtcaggaaacgttcatgaaaatgcaagctggtgagcaggcaagtgcccccctgcatgacagaccctcctggtgcccctggctcagacagtgtgaccttgagaacagcgggggtctaacccctgaccccagcgtccgtgtcacctgggagcctcaccttgagacccctgcgttgtggttctgaaatcacttgagtgggccgtggccaccgtgaggcggagaaagaggaaatacctgccagaagatcaaattgcaatccgtgtaatttaaagatctcactgggctttgttggcgattctagagtggggcagcactgcattccatgaactagaattaagagctccagtgaaacacgcagtgcggggccggctgtacagacagggctgaggaaagcagaaactgtgcaaacgcggttcggcggcctcagtcactgtcctttgtaagcttggggagtcggcgggagagacgtgacccactggccacttcaggcggctctgtgtcgtaaggatcagtttcacattaggtgattgccggacttacatcaagcttgaagaagcagaagatccctgcacacacgtgtggcccagaccaagagccgtcacgtgacaaactttgtgcttaaatgggtttttagtatgtgtatcttttctttttcttttttttttttttttttgagatggagtctcgctctgtcacccaggctggagtgcagtggcacaatctcagctcacagcaacatccacctcccaggttcaaaagattctccagcctcagcttcctgagtacctgggactacaggcacctgccaccatgcccagctaatttttgtatctttagtagggagggggtttcgccatgttgaccaggctggtcttgaactcctgacctcaagtgatttgtccaccttggcctcccaaagtgttggcatttataggcgtgagccactgtgcccggccaagtacgggtatctttttggcagtgtgaagaatttatttaggcttgactgttttaaagcaccataatgaatgtataattaagttatgataaagtcttaaccctttgttacaggggaacggtaatgttgtgagtggctgtgtctcagcccctggactccagcagtcaccctcataggagtcccacctctgcgggcagctcagagcctccatgtttttatatttaattctcatggttaaattcagtgccgtaactcatggaattaagtctttttaaaatctaagcaaactgtctttaagacagaaaaagttgggtaattcttcatctatttgaagtgatgctctctggatgggctgcatcctaagaatgtatcaaaagtggaaattctgaccactgttttgattgtccttttacatattaaacaagttgagagcaagaacaacaaaaagagggacctccgtgaccacgccgaggaagacagagcctggcctggttggaagattggcctctcctctgtctcctgttttctccaaggtccgataacaactcagtttcccttggagtgtggggacttcattttgattttcagtctgatctgttggggtctaggcaggagcttggtcccaaacaacacacccatgtgtgctgaggacacgctccaggggattcttacgcccgcctgcatcagagaacccaggtcttgtgggcgaggcagcgtggagagggagcgcagctctggagacggcccccagggcttgcgggcgggcgggcgaggcagcgtggagagcggagagcgaagctctggagacgacccccagaggagattggccaagtgcggatgtgcgagtcctccctgcccgaggcgcaaactgtctcactccaaagggcgtccggagggttctgcggggcggctgtgcactgacacctgccccccacgtgggagtccgccggctcctggcccttgccggttggtgttgcgcgtctgagatgacgcccctgcggtaggagcggggtttccctgatcaccgcttcttttgaccatcttttctggcagggccttgtatttttaaaatgtgtaaaggttaagctttctgagatcagaaaaataatatttagtgaaccatgtgatttaagtcactgtgtatgtgacatgaaatatttatacctaacccactagcaaatggctcgttaaacatatttgagatttaatgtaagtgagaattctgccaaccaagtcaggataaaccttaaacatcgggaatgcaaaatcaaacagatcctttaacacacatcacaaacagaggtgtggacgccccttttgtcccaatggcagggacggggcgctggcccccagggtgtcctgtttatcccctgacccacacagtgtcaggagcttgtctggaggggacggggatgctggcctcctggggtgtccttatctgaaggctgtggtttcaagcatcctccttactgaatttagattttgttccgattttgtggcctgcgtttcttcttactgccctgctctgtggccctgttcttcctgggtttggagatcctcaaggatgggcttcgggaaggcctctggccggatgatctggtgacgtaatcccatctgacgctcagccttggactttgaaaaggcacgactgtcctgtctgatggacaggatgcagaagcctttgggaatgggcattttgccagaataaataaaagaagacaattggcaaaagatggactgtaccccatggccccaggctgctgtgtggagagacttgtcctctcctctgcccacggtcaccagtgagcaccagggacggggtttcctgctgcacctgggcctcttcctgctgccaggagctgccttgctgcctccacctgtgacagtccaccccccataccccccccacccgcaccatgagaggatttccagggcccacccgcctccagtccccgttctctctgctgctttcgaggtcaccctgggctggaaggggtgcctgggatactgctcagacgtcttggccgccctcccaccccgcaacaccccgctcctggttttcaggatgaaattgtcctcaaataaagcaagcttttgagtcaacttgcaagaggaaggaagtttgcttcagtcgtctggttttgttggaacaaagagatctaaagatagacacatggtccccctccctggactgccattgccaggaccctgtttctgtgaggaaaagtcagtggtggggcctcacctgtgtatcaggtgagccaagggcacctctgcccttcccacgcttgggaaatctcaccacgtcgtccccgtagtggccagaagagattggccctcccaggtggggctgctgtggtcggtgctggggatgggcaggggcaggcctggccaccccctcgtcggccccacctgctgcctctgcccgcgtggcaggggaatggacggggcagcctctgccgggcctcagatgtgaggccctaaccctcccctctcagacctgcctctgagcagtggggtcatcactggggagttggttggagcagggctcagtgagggagctgggcctggcctggccttgggtggcacatacgggtcaggggcccaccacctcccagacgtctgacagcacagagccccacagaggccatgctcgcctgcctgcatctcctctggggacctgtctcctgaactgagtggccactattgttcctccgtgcgcttcttagtcttatggctgcaaaattaagtagactggaacttttaaagaaactatgatcataagggcagattttcccatcattcttgagtgggttcaaaaaatcaagaagaatgaaaacttacacacataaatggaagaaacgcccagcgccctgaaaatcccagggccccgcctgcagaaggcctccatgaagaacggaagaaggccaacactctggtgtgggtcagagagcatccacaggcctcttcaggttcacagagtggccagtgaccacttcagatgtagcgatattttagagtttatttgtatgagggcttagctgtgtgcagtttctgatcacacacagggggatccctgcttttcatacccaaaatgaggcatttgatctgagggacaatatttagagtttgtcctggcccagagagtccagaggcactgcgggctgccagcaggtagacagtgcagtgcagatgatggacaggtggtgtggacggtggacaggtggtgtggatggtggacactgcagtgcagatggtggacaggcggtgtggatggtggacaggtggtgtggacggtggacaggctgggtggatggtggacactgcgatgaggacggtggacactgcgatgaggacagtggacaggtggtgtggacggtggacactgcagtgtggatggtggacaggtggtgtggacggtggacaggcagtgtggacggtggacactgtgatgcagacggtggacaggcggtgtggacggtggacaccgtgatgcggacggtggacaggcggtgtggacggtggacaccgtgatgaggacggtggacaggcggtgtggacggtggacactgtgatgcggacggtggacaggcggtgtggacggtggacactgtgatgcggacggtggacaggcggtgtggacggtggacactgtgatgcggacggtggacaggcggtgtggacggtggacactgtgatgcggacggtggacaggcggtgtggatggtggacaggcggtgtggacggtggacaggctgggtggatggtggacactgcgatgaggacggtggacactgcgatgaggacagtggacaggtggtgtggacggtggacactgcagtgtgaatggtggacaggtggtgtggacagtggacactgcagtgtggatggtggacaggtggtgtggacggtggacaggcagtgtggacggtggacactgtgatgcggacggtggacaggcagtgtggatggtggacaggcggtgtggacggtggacaggctgggtggatggtggacactgcgatgaggacggtggacactgcgatgaggacagtggacaggtggtgtagacagtggacactgcagtgtggatggtggacaggtggtgtggacggtggacaggcagtgtggacggtggacactgtgatgcggacggtggacaggcagtgtggacggtggacactgtgatgcggacggtggacaggcagtgtggacggtggacactgcagtgcggatggtggacaggtggtgtggatggtggacaggcggtgtggacggtggacaggctgggtggatggtggacactgcaatgaggacggtggacactgcgatgaggacagtggacaggtggtgtggacggtggacactgcagtgtggactgtggacactgtgatgcggacggtggacaggcggtgtggacggtggacactgtgatgcggacggtggacaggcggtgtggacggtggacactgcagtgtggatggtggacaggtggtgtggacggtggacaggcagtgtggacggtggacactgtgatgcggacggtggacaggcggtgtggacggtggacactgtgatgcggacggtggacaggcggtgtggacggtggacactgtgatgcggacggtggacaggcggtgtggacggtggacactgagatgcggacggtggacaggcggtgtggacggtggacactgtgatgcggacggtggacaggcggtgtggacggtggacactgtgatgcggacggtggacaggcggtgtggacggtggacactgtgatgcggacggtgcccccacggtctgtgaggcaggcaggggattgaggacagtgcctcctggtttcctctcaggtcacagtcgctcctggtgagagagaaaaacttaccgtaaaatctgaacatccaactgcgcagtctaggctgccgtcggctgcaccagacacacattccagagaggtgtgcaccagtggaagtcaccttgccaggagcatgagatagtatttcatgctttactgattgactgtttctgtctttctcccacaaaagaagccatcgccgagacgtggttgcgtactgggaatgggtctgtgccctgagctcgccctgcaaggctctggggaagggccttgacatctgcttggctctggcaggtcccatgacaccgtggccctgctgcttcccccccaacaccagggttgtgtctggctcggaggcaaagcagtcccatagctggcagggccgcagccagcacggcccaggaggggcccctttgtgttccactgtgtcccgtgtttacacttgtttgtctgcaagactggaagagcaagatttaagtctgatgccaggtagatattatctggcagcctccgctgggaatttccaggtacaaacacctctgtcccatatcttcaggctgttagtgacctgggtcctcaggtgtggaaaaattgagcgtttaagccattctcaggtcatcagcgtgagtcctgcatcttttagagagaaattgtgtggatgttcaagactgcaaatgtggctatatgatgagagcgttggccagaaatcgtgtctgctccgtggtcagtggtcagtgtcccccaggcacagtggcctggcagccgctctgtagcagagaccaccagcctgtcagtccgtacagctttccctggagggtcttgctggccccatgctcccggctggtgctggctccatgctcctagctggtgctgaccccatgctccgagctgatgctggcctagtgctcccagctggtgctggccccgtgctcctggctggtgctggccccatgctcctagctggtgctgaccccatgctccgagctgacgctggcctagtgctcccagctggtactggccccatgctccccccgtgctcccagccagtgctggcctggtggctgcaggtgctgcagtgcgtccagagccatctggaacctgctgggtggggggatgggtgtgggggtcgaccctgctgttgccatcctgcctcatttgtgtccgtctaatggcgaggccagggttgtggcacagacccccgagggtcctgtgtgtgcggaggcagaggcccattccatggccaggttttcctcctgggccacaagttactgcacctgcaacaggtgcggggcaggggtcgcctgaacattttccctaatgtgggtgggactcagaccaaagtgtatttatccgaggagccaggaccaagccctttcccactgctcccctgcctcccctctgcccaggtctctctctttgtccctccctctctctgtctctcagtccctctctctgaacctcttatatcacactttcaaaattgatggtgaatcactcaacacacagcttttatgcgctgagaaacaaaggcctccacgtattggaaactgaaaagcctttttccagccacgtgacgccactcccgtaggtgcctgtggatgtgccagctccgtgtgggatcgggtgggcgcttgcagggtgaggcagcttcctgggactgacacgtgccgtctgctctttccgtgcagatgaaatcatgcaccaggacatcgtcccgctctgtgctgccgacatccaggaccagctaaagaagcgctttgcttacctgtccggtgagttccagaagctgggatggggtggagagggaggggtctggggccgggtgtgggccgagcagcccccgtggcctggcccaggctggagctgggaagggtcatgcgaggggctgtgtattcactgccttgggtctgacctgtgacctggctctccccatctctgtgaagtgggcagctccatgccagttggcacatggccactgggaggaggtgggtggaggagggtcagggtccccagggggatgtggcctgggcacccctgacagcagcctccagggacagatggagtggtgtgtgggtggccgagcccatgggcctcagtgaaccccagttcctgctgcatctgggcacctcccaggccacgcctctgtccactgtggcctccagccctgcgtctggcacacctgtggaggtggtgcctgcagccatggggacataatgaggctcccagcacccctgtgtgggtacagcaagggcacctgcagtggccccgagctatgtagatgccgttcttatgtgaacaaatctgcccaacaggacccgtcagaaaaaacaccatgcacatgcatgcccaccctgggccatcagggtgccccgatgctgaggagggtgccccgatgccgaggagggtgccccgatgctgaggagggtgccccgatgccgaggacgcggtgctcttgggagctcagcctctgcccctctgcattcccgtcagcatcccggcccccaatccatggctggcacggtggggcctccatcccgcacctgcacctacagagccagcctgcaccccaggccgggccttggggtctgagggaggctgactgcgaggtgcagctggtgagttttatgagaccaaaatcgaagagacagccagcaacatgatggccagaggagaagtgctgtgcagtgacttggtccctgcttcccatggccaagtggcccaggaggaggaaggagagaaagcagggggtctctggagaactgaaaactcccagaggacaagggctccaatccccctgtgtcggggaccaggcgtggtgatggctcaagagaggcgccgtggtttctgccggttcctcctgcgtccccagcctctccccgcccctttcacaaccccaaagaggctcacagctttgccaccaggagggccccgacctgggcctccagccttgaccttcctccagttgccaggcagtgcccccaccccagcggtgcctgggagggcagagtcccaggacggccccagccacccaccttttctcgatcgttcctcagacgccagcccaggagctctgggggggattttgcagatgaatttaaggccccaaatcagctaactttaagatcttccttggtgggcttgacccactcagctaagcccttagaagagatggggctcttcctggcatgagggatcccaggtgcaagaaggatttgacacaagggggttctctgtgtggccccgaaggaggcagaggccgcctgaccaggacaagagccgccccacgggcagccgccaggaacccggggcctcaacactgcagctgggggcacagctctgccaagcccctgggggagctggagagactgggctcaggatcacagcccggcaacccctccacgtgggcccagagaccctgagcagagacccgcaagctgataagtgcctgagcgtcaatggtcttgggaaccacaccaaagcctccgtcggctcctctccctcctggaatataagatggagtcccctgtggtactgctgcccccgcgtcatatgctgcccccgcgtcgtatcctgcccaccccctggaggcaggctgcctccccatccccctgcctcccgccaacctcggggcctttgcacagccggccctctccatgcagcgaatttcttccgcggggcttgtggctggcccggcccctcaggccttgctcagaggcacgccctcgtacatgccctctccctcctcgcctgcgctctgctccgcccccttcgttacaccacctcacgtcctcccgtgtgtggcgtgggtccctcctgagggctgggtttgttcacagctgcctcccggcttctagaggtgcacccagcctcagagccatgtactgagggctcagccatgggcccatctggggtgggaccctggcacaccacgctgttctcaggatccaggtcgtagcagcagtaccacgtctgagaaggatcagtgtcggctggcgcttctcctgcagatgtgcgcggatttggaggaagcctgtggcagcctcgggtgtgtgcgttgccaatcgccccgtcccctcctcaccacgtccagcactgctgtgtcctgaggctgcgcctgcactccgggttcctgccatgaagcccccttttgtgtcctcatgacaaaggccatgcactgggggaccgaaacaactggggctcgtctctcaggttccgtggggctgtgccccttccggaggctcctcctgctttggggacgcaggtgttccttggtgtcccttggcatcttcatgcagccgcctcacctgtacgtcggtgtctcctcttctgcctcaaagcccctctgcctttctcccgggacacccgtcacgagatttagggcccaccgtataatccattatggtctcaccctgaaaactttgttacctctgctgcaaagacttctccaaacaaagtcatgtttacaggctcctgggacagggagtggacgtgcctttcaggggccgccttggactcagggtaaatctggctcagaggtttgctgtcttgacagctgccctcaagggggctcccctcccgccccagcatcacccatgggactcgctctccctgtctcgctccactcgaaggaaacacagactcccccgcccgccactcctgcacactgaccaccatggggctggggtccagctgggtgaggcccctcattgtgactggagcccacaggtcgacaccccagcctgttccgtggacttttgcttaattccctggtctttggatgcctggaatggcttccgtgaagtgccagagcaaaaaactaaagatgtcaggaaggaatggctccgaattttccttttcaagaggagactgcgtttctttccacttgccctgctgatttcccctccctgcgacgttcgtgccagccctgtgctgtctgccgcggagccatggctgccactgtgacatgtgcggtcccgtcttctccctccattgtctgtagacgcacaggtgccacgcagaaccctacagctctgtccagatcctggatccagatgaggcagcttttgaaaggcggccaagtgagggatgcgtaaacctcgggggctccggactcctgtacgttgccgcccaaagtcaggacgagctgcggaagtcacacctggactctgtgtctgtcatccgcagacagcagctccccattcagcctgtgtccctcgtaatccacaccctctactcacagtgacatctgccccaaaagcgcttcgcttaaccctgaagctacgagacctgccaccctactgtcccctctagttttctgacatttgaggaacaaggaattgggtgtaaaatcaggaaatatcctacatgtaaattcttgattattcttgtccttccgggcagagctgcctcctgagtcatccgtttgactctttcttactgaaggctgagggttggggggtgcatgggtgctccaaacccagaggcaatggcgcgtcccctggcatggcagtcggagcaggccccgaggaggtcgtggtctcagaactcagtccttgtgtcatcctagaaaagatacttcaacttgctgaccgtcagcaagagctaaaaacagggcgggagaatttaccactgaggaacttatgatctgaagtgaaaaacgcagagaacagacttgccaccggtgaaaaccacaaagctgaaatggaggccctgcccggaacgcagaggccaccgccactgtgcgtctcactccctgcaatggacggcggcccccctcccactgcccaggcggctcttgggaatttcgttttgcttttacgggaatgtggcatggtcagcggtggccatcagccatccaggaacctggatttgacaggattgctccatcccatgtccaggcagcctcaggtgtgtggagacagggcagacttaggagttcctcccctggcctgtgctctcctcccgggaagaacgctggagaccttcgtctcttctcctttcctcaccttccccaagcgctcgctgcacaagccccctcctgccttgccccttctcccaccccatttcggttttggtcccagcttacatctcgtcctaaggattaagtgtttgtgcagctgagccgcagttctcaggtgagctgcagggctccagcatggcacctgcctgggcagtcctgagagagggattcgaagtggggaaggaccccggagtctccctggcacgtggtctgaggctccagccaccagacccgaagctcagtctacactcaccaaggcccgacggctgctccaacctgggaggaccgatccgatcctgcgctccctgaggccgatggctttttgacacccaggcttcagccacagacagacagacgttccctgcccgtgggggtttgcccttgctggagagaaacagaaatggacagaaggtcactggggtggccctgggtgttctgcggagaatcaaagtcatgagacggagacaggaatcccgttaggtttgggcagagtcgcacgtgctcctttctggacctgcttcaaggaatccgatggtttcacgacatccaaccagttgctataggataaatgtttgtgtccctccaaactcagatgttgaaaccctaaccccagaggtgatgtttggggaggtgaggcctttgggaggagattaggtcatgaaggtggagctcccaggtgggatcagagcctttataaggggctgaagagaccagatctccttccgcagcatggccatgcctcaaggagacctctgaatggggaagccgccgtcaccagacaccaagtctatgggcaccttcatcttggacttacctggccagagctgtgagataaatttctgttgtttgggcctcccggcctatggtggtttgttacggccgcccagacagaccaacaaacagcctgtgtgaaaatgcgagccataaacgagtggtgttgacaaaggcatcctgtccaggtaggagttccgtgtggctaagtagtgtctagtttcagaatgtgatgccttcttgatgtcatctccacactggcaggaggaggtttttatttagttcttattttaagatttttctacccgacagttaacttaggatacagatgtcatagtaaattaaccactggaatgctttcattcctaagcagctcatgtgggtgagtttctaaagccgtgtttgggccgaggcatcacacaagagggtgtccctaagatgcatcacgtccgtggagaaaacaaagcaggacacacgtgtgagtcgtcacacccttggtcacccggcttggccgtcacacatgcctcctgcccaggacgcgtgtgcgtgtgtgtatctacctgtgtgtctcaactcaggctgcttgctgtgacaaagtcccctagactgagtggtttaagccacagtttatttctcttggttctggggcaggaagtcccggatgaaggcaccggcagatgtgctgcctggtgagggctcacttcctgatttacagactgcagccttctcgctgtcctcatgtggccaggcgagcagagcaagcccacagaatcccattcacgggagccccactcccacggcctcctcccctcccacaagccccacctcccagcactgtccccgtgggggtcagcatttcaacacatgaattcaggggaagacagacatccagtccataacagtgtatatgtgtagctgtgtgtatgtgtagatgtgtgtatgtatagtgtgtgcgcgtgtgaatgtgtagctatgtatgtttgcatgtatgtgtagtgtgtatatgtgtgtatgtgtagatgtgtgtatgtgtagatgtgtgtatgtgtgtgtatgtgtagtgtgtatgcatgtgcatgtgtagctgtgtatgtgtatatgtgtgtacttgtagatgtgtatgtgtgtgtatgtgtagctgtgtatctgtatggtagctgtgtatgtgcgtgtagctgtgtgtgtatatccatgtgtgtatatataggtgtgtatgtttgtacatatatgtacatatacatacctacacatccacatgcatatgtgtgcagctgtgtatacatgtgtgtgtaggtgtgtgtctagctgtatgtgcagctatgtatctgtgtatagctgtgtacatatgtgtgtgtttataagtagctgtgtgtgtaactgtatgtgtgtatatgtacatgtatgtgtgtataggtagctgtgtgtagctgtgtgtgtattaaactgagtgtgtatctcacactaaagcagatcccgtaggaaccacacttctttctggtgatggggatgagagggagttgcatctgccttctgcccctagcgagtggatgtaggcccagttgcttgggtgcgagagttcacatgcaggtgtgacaggtctcagccaggacagtggtttttggacgtgggtggggaccggaggctgcccctggtgctgtgtggacagggtgctgttctgaaccacagaggagcttcggagccctctgtcctctgcggcgttcagtccgcctccagttactaggccgggtgtagacacagaagtagagcctgttcttggtgccattggccccgggtcctggcactgcccaccttggtggggagggtttctccagagaggggctgtgcccccagctccgcgtccagcggtgttttgctgcctcataacctgcaggtactgggagctttggcgcctgcttttcagtctcagtggacagactgggatttccactcctgacttgggaagaaagaacagggtctttgctttgcattgaggctgtggtggagcacagagagttcagagatacccagggtagcagcagcctgagaccagcaccagctaccaactgaacgaggctgtgcggcccaggccaggcccccgtgcgatttcagctccgggtcacctggcccccatcctctcccctgggcagctggaggctccaggccttcctgtggctagctcctgccccaaggctgccctgctgactgcaccctcgaccctgtggctcaggctggcctctgggggtccccggtctctgtggttccagtgaggcagcagctcccagatgccacctccacactgtgggtgggccagccagtgctgagagggagccactctccacctctgtgtccaccatccactccaagctcccaggctgcctccacgttgtgtccaccgtccactccaagctcccaggctgcctccacgtttgggcatgaggggatcttgttgcatccgctcctcttcctagctgggccctccacagccagtgtaccccaaggagcagcttctccctcccacccacccccgccggccaggggtcctcatgccgtggcccatgcccatttgcacagggacgcagggggtctcacacacaggcagggtccgcccccagctgccgtcggcgtcactccacacacataggcttctgggcggtgctggaagcttctggcccctgaacgttccccccaggccccgtttcagggaaaggaaaggcaggcgcaggctgcggccgtttccacaatccacctcgtagctggggcgtgccgcttgcctcggcttgtcccggcagaacactcttacctttaatggcgactgaaaagttgccacgagttcctgatcattgtggtaggtgctgcgtgaagctgagacgtgcgtgagccacatcccagggggctttgagcccccaccgcggcggcggctgaggggaggcttgtcgtactcgcacaggaggacacagggctgcagtgttcactccagggcctcttatcattgggatctgaggaattttccgagaggaagtgcgaattaacaatgatgaaaggtttgtgagtgagtgacaggcacgttctattgagcactgcatggggcattatgtgccaccagagacgggggcagaggtcaagagccctcgagggctgggagagttcggaggatagaagtcatcagagcacaatgaagccagaccctgcagccgccttccccttcgggggcttccttagaatgcagcattgcggggactgagctgtcccaggtgaaggggggccgtcacggtgtgtggacgcccctcggctcagccctctaagagactcggcagccaggatgggctcaaggcatgagccctcaaaggaggttaggaaggagcgagggagaaaagatatgcttgtgtgacgtcctggccgaagtgagaacaattgtatcagataatgagtcatgtcccattgaggggtgccgacaaggactcgggaggaggccacggagccctgtactgaggagacgcccacagggagcctcgggggcccagcgtcccgggatcactggatggtaaagccgccctgcctggcgtggctgggcttggccaagacccagaagcagaagttccggaagctggagacagtggctgtggggggcgcaaggcggcgggggactgtcgctgttacgagacaaagctgcagttgtcggaggctgtgtgcaccctgggtcttctcagtgaggacgtggatgaggggcggcgaacccaccattatctgttctccataaaaagctaccctaaacttagttagcttgaaaagccctattttacagatttattcttcatttagtggctcagaagttccaaaagggctcagccaggtggttcttcactccacgcacggggcactgactgtgtcctctgctcagctgtgtcctcatgggggctgggctggaaggtcctgggggctgcagtcccgcacctccacctccctgccctttcacaaagtccaccctcaaccctgggtactggcctcctcagagcaggtggatgcagggtcgtgggaccacctgcccaatgactacagggcatgagagggcagctgcagtgttctgagtcccaagctcacttccgctgagtcctgtgggcaaaacagatcgcaaggccagacccaggctcgggggagggaaatggactccgtccggccaaggcagtgtggcagggtcagtggccggctccagcaggcagacctggagcccagcctgtgtgactccaaagtcagtgttcgaatggagctctttggaattgaattgcttaaaaggcgccaatgtcggagaagctagacgatacccacaaacagtacagttaggcaggttattagtgcacatgcatatatggaatattatgcaatatttaaaataatggttacattgtttaaaagcatggaagcggtttgttctcagtgtcaggaaggaggcaggagacaagcttctctatgcagtatcacctcaacaaggttaaaaaagcccatagaaaaaggcttggaaagaagcatgttgaattgtcacggtagctgtcccatggtggccaaaataacgagtgattgtctaaattcacatcacttttgtgtactttccaaatattttcttcaagcagcacacatttctttcaaataaaaattatgcaacgatgaagaacatgcctcagttttaactgaaatactgggtgctgatgaaaacgggccgacatctgtggaacccccgggggcatggagccctcggctaagggtctgcctctggtctctccccaggtgggcgggggcaggacggaagcccggttatcaccttccctgactacccggccttcagcgagattccggacaaggagttccagaatgtcatgacctacctcaccagcatccccaggtacgtgcacccagagcccggcagacattgtggtttggggcagagtccctgtgagatttcaccagggtggggtccctgcaactatgggatgaggcagagtccctgtgagatttccctgtcatggggtccccgtgactgtgggtcggggcagagtccctgtgagatttccccatcatgcggtccccgtgactgtgggtcagggcagagtctctgtgaggtttcatcatggtggggtccccgtgactgtgggttggggcagaatctctgtgaggtttcatcatggtggggtccccgtgactgtgggtcggggcagagtccctgtgagatttcaccagggtggggtccctgcaactatgggatgaggcagagtccctgtgagatttccccatcatgcggtccccgtgactgtgggtcagggcagagtccctgtgaggtttccccattgtggggtccccgtgactgtgggtcggggcagagtccctgtgagatttccccgtcatggggtccccgtgactgtgggtcagggcagagtctccgtgaggtttcatcatggtggggtccccgtgactgtgggtcggggcagagtctctgtgaggtttcgtcatggtggggtccccgtgactgtgggtcggggcagagtctctgtgaggtttcatcatggtggggtccccgtgactgtgggtcggggcagagtctctgtgaggtttcatcatggtggggtccccgtgactgtgggtcggggcagagtctctgtgaggtttcatcatcgtggggtccccgtgactgtgggttggggcagagtctctgggaggtttcatcatggtggggtccccgtgactgtgggtcggggcagagtccctgtgaggtttccccattgtggggtccctgcaactatgggatgaggcagagtccctgtgagatttccctgtcatggggtccccgtgactgtgggtcggggcagagtccctgtgagatttcaccagggtggggtccctgcaactatgggatgaggcagagtccctgtgagatttccctgtcatggggtccccgtgactgtgggtcggggcagagtctctgtgaggtttcatcatggtggggtccccgtgactgtgggtcggggcagagtccctgtgaggtttccccattgtggggtccccgtgactgtgggtcggggcagagtccctgtgagatttccccgtcatggggtccccgtgactgtgggtcggggcagagtctccgtgaggtttcatcatggtggggtccccgtgactgtgggtcggggcagagtccctgtgagatttccccatcatgcggtccccgtgactgtgggtcggggcagagtctctgtgaggtttcatcatggtggggtccccgtgactgtgggtcggggcagagtctctgtgaggttccaccatggtggggtccccgtgactgtgggtcggggcagagtctctgtgaggttccaccaggctggggtccccgtgactgtgggtcggggcagagtctctgtgaggttccaccatggtggggtccccgtgactgcaggatgaattagggtctctgggagccatcattgagttccccgtggctttgctgaggggttagagctttgtcagcatcatggttccgaggagctcaggagtctgcctcagatctgatctggggtccgaatccagctttttcgctcctgagctgccgttttttcctggagctcggaggcccacctggaggcccagttgctcagcagtcgggatctgacttagcctgagcgctgctgtgctccctcgtataccatcactgcgcatgcctgttcgatcagcagagttctgcggtgcgagggcttctgtgttcttaatgccgaggagcccatctgcacgggacctgatgctcatgggagcagagcccgtccacgtggcctctctgtgtcgtggtcaggccctgggggcgtggccgcctcctgccctttccaggaaagaactgaccccagaggtaccagaaaatccagttaacaaaaatggttccctcaggctgcagttttttgttttgttccagacagagctgggtccctgtcctctgaaaaggtagggagcccagttctgtgtctccccagcggcgggcaggagagcagcatcaggccggtgagctgcaggctgacttgggaggggtgccgcgggggtctctcatctgatgtgctcgtcccagcctccaggaagatgctgagaatgtcagcctcacaccagacagtgtagttgctgcttccatttggggtatagtgaacacacaccaagtaaaaacagaaatatccttaaatatggcatctgtatcccgcacattacataaggtggcaaaacacagaggagatgtttaaccatcagcgtgaaagtgcagccgtggccattaccgtgaaggttcttcattcttcagtctttaaagacaacagcgcactgggcctggtaactgagagctcagcccgtcggcctgacctggaaagcagcacattgatcccctgataaatatcacataaccaccagctggcagcagccagcctctgcagtcatgcctcaaggagagggagagcggtgggcacctctgtccacttggcgggttgaggtgggagctggaggagcagggagcctcaccggtgggcctttcgggggcaggacgtcttggtgggcagaaagaagggggctcgtgactgactatggtcaaagccctggacatggcggtgtcctggtagccccaaatcactgtgtgttgggtttgtggttttgacctcagtctcttgtctgttgtgagaatcttgcaccccctatgcgccaggctctgctggctgagctgagtgcacggaggaggggctgggtctcgggccgagcggccgagctccctgaggggctgatgggaccggcttggtggggcaaggctgcgatgctgcagacggtttccacacattcctccctggttctcagccacactgtggcaggaaggcagttattaagcccatgttatagatgaggcttaataacacggtgatggctggagaaaggggatggctgggcaggggagcgcccgaaggctcagaccacatggccgtaccccgaggacgtaggctccaggtgtgctgtggccagaggggtgtcctggggagggcggtcatctccaagcctccaggcctttgtctgtcacctgcacaggaggaagggcctgtgtcccaggggacggccggcctgacaggtacatccgccccctgatggcacctcctggcatggggctaaatgagattctgtggtgtccacactgaatgctgactggtcagactcatgctcagaaatcagggctgttgtcagtgcttgctacttggagccatgagctggggcgcctcctgtttgttgaaccttcctgtctcttttgtcttagaaacttcatggagtcccttagctacccacatccctttctcaagatttttctagaatctgcggagttccttagctacccacatcccttttcttgagatttgtctagaatctgcagcactcaaaggccacccatcaaggccataagagtgtggtaggcggcacgtgttcatgtgtgcacgcctctgtttatccgatgttctggaaccttccatggcctccttgctgctgccccacttgtctgtctgcttctcctgagatccaggaatctcagatgggtccagactcctgcaggacaagacccactcagccacctctgtagattgcgcatctgtgagtcgcacagcctggtctggctgaaggtggccggagcgcaggcccagtccccgctgtggacacgcgggccccaggttgctcagaggcagctccatggatccccactgttcacctgtgtatggaaactcaggttttctggtcacacttagataataaaaagtggaagaggcctttctatcaccaaacgctctaaatcagatcctggaaatgccagcttcattcagccatgagcagtgctgctgaccgtggagctgtttcccccaccagactcagtgtgggtgtctgagtgtgtggtgtgagtgtgtgtaatgtgagcctgtggtgtgtgtggggtgagtgtgtggtgtgtgtggcgtgtgcggggtgtgtgtggggtatgtgtggtgtgtgtgtaatgtgagcatgtggcatgtgtggggtaagtggtgtgtgtggtatgtgtggactatgtgaggcatgtgtggggtgagtgtggggtgtggtgtgtggggggtgtgtgtgagcgtgagtgtatgcgtgcattctacccacgtttcctttcttcccaggtaggtctcatcagtgtcagacccaatgctccctttctatctggaaataaaactctttgataacaaaacccaacctgtgtgaatttgggaggacgcccatgtgccctgatcagaaggacccacagaagggaagctgcgggcctgtaagagccacctgtcccctggctgtcccggcatcctagggcgcagcagccgcggcagctcccctggatttctgtgagcacggggctgcaggcgtgctgtggggaccccgtgcctccagggtgttgccattgagcatgtccttccagagagagtgaacaattcttgacacatttctaagggaaatcttcttcctaagggcatctacgggatgccttcttgagaagtgcagagtgtgttaaaaatgtgggggtcaatcatggcctctgcagataaaaccagggtccctgcaagccttgcaggtgcagcttggcagaggggaccgtcccagaggaagtctctgcatccctggcgagcaaaattgccaggctagtgacaaggaggagacctgcccactgcgccctgagggtgctgtgtccccgggaagtaccctctgcgggggaccctcttcccaaggtgggggcggggctgccctctgctggagacgcggagcattgcggctcggtcccgggacatccctgggagaccaagagagggaggggagcttggaccttttcttccaggagatggtggacgagaccctggcacaggcggttccccagcacgcagtttccagacagctgcacagccagcacattctttaagtgggaaaaaagtgaaattgaccaggcctgttctttcacatgtcaatgcaaattaaatggacaaatctctcgtgaaggctgcttttaaggggtttcaactgttacattctaaaccaagcatcacttttatcaatttagaaagaatgttgtattctaattttaactttccttctgttttcatatgcaaatgccaggtgtcccaatttaagcactacatctgactatactcatcatttttggaatattagactgaaataggtttgccccaaatggtttggggcacctgttaatataaaccaagtttttggtccttggaaagacgactcatcagggcgaagggggtgagctcgtgctttgctgactcaggtgtctgccgacgcccggtgtggactctcaggtgtccgctgacgcaggtgtggaccctcgggtgtccactgatgcaggtgtgggccctcgggtgtccgccgacgcccggtgtggaccctcaggtgtctgccgacgcccggtgtggactctcaggtgtccgctgacgcaggtgtgggccctcgggtgtccgccgacgcagatgtgggccctcgggtgtccgccgacgcccggtgtggactctcaggtgtccgctgacgcaggtgtgggccctcgggtgtccgccgacgcccggtgtggactctcaggtgtccgctgatgcaggtgtgggccctcgggtgtccaccgacgcagatgtgggccctcgggtgtccgccgacgcaggtgtggactctcaggtgtccgctgatgcaggtgtgggccctcgggtgtctgccgacacaggtgtgggccctcgttcgtcagagggcaggttcggatctctgaaaaccctatagcccttcctactcctaatggagctccatttaaccaacatcggccaggccttgataggagccaaggtctcagagaggcgatagagaccagcgacaagcagattccagaccctgtatggcccccttagaaccacatggccggggaggagatgcacaggtagacggtcagacctgtgtgtccaggcactgcttgctgagaagtctcagtggtcagcacacactgggaacacaacagcaaataaacagagaaaattgtggcgctgagacaatatgtcagctatggagggcgtacagggcagcagggctgtgggaaaacaatgtgagaaagaaagagagacagagagacagagacagacagatacagacagagagacagagacagacagatacagacagagacagagacagagagagacagagacagagagtgacagagagacagacagagacagagagagacagagagaagagacagagagtgacagacagagacagagagacagagacagacagagacagagacagagagagacagagagaagagacagagagtgacagagatagagacagacagacagagacacggagacacagagataaagagagcacgagggaggcagagggcaggggtggcagcatcactgcagacaaggaacttaatgtaaactgggaagcattcgtcacagagatcccaggagggcgccagcggcatctttgggggcagcgaacgcaccagggggcaggacagagtgccggggagtcgggggctgtagggacagagtctgggaggtgagacagggtctgtggagccttttctgaggagctgtgttttctgtgaagtgggtgccaaagagttcatgagctgccagaatgcagggtggagggagaatgcggggtggagggaggagctgggagatggggaggagggcggcggccctcagagaagggacgaggtgggaagcctggagcttgctggaggagcagtgtggaaggaattcactgaagctgatgatgacgcttactttccatgggcctggctcaaagctcccagctccttgggaggtagggactccatctaccagccagcttgccgggacaggggtcacattcagcccataagaggcatgtacacatacagatgcacacacgcacctacacaggcttgcacatgccacacacacacacacacacacacagatgcacgcagacacgcaggcactcatgcacttacatacacagatgtgcatgtgtataaccacacacgtgcgcacacacacacatgcaagtgcatgcatacccccccacagacctgcacatgtacacaccacatgcatgcacagtttgtgtggtgtatggggagggtgcatgtgggacgcaacagaaacacgaatgtaatcattaggcttccagtcaagaggagagtcctcctatctcactgattctaagataagcacctggagccaactcggtttgtcgtccccctgcggtgacctgagcaccctgtcctgctgtctgagctggagggcagctggaccccagcccttggaagagccccacttctcgctgtgggtttgatttcctattgaactttgaattggcttttgaatataaggacaggaagtgtctgtgagcgtgtgtgagcgtgctaaacaatttaatacgtgtgcattaaaaagtgaagcttccacttcacctcctgcttccctcccccacagctaactgtggagctgcactggggtgacacccaggctgttcatccacgtgtggtgggacagcacaggacatgccgcctcgcagcttgctgcttctgttcagcggtgtgtcgtggcgcccttctaccttggcgccatttgctgctgcctttcattttatatatttttttttcatgttttgagacagggtcttgctctgtcacccagactggagtgcagtggcaggatctcagctcactgccacctcaacctcctgggcccaaggtgatcctcctgcctcagtctcctgagtagctgggactgcaggcatgagccaccacacccggctaatttgggtattttctgtagaaatggagtctcaccatgttacccaggctgatctagaattcttgggttcgagtgatccacccaccttggcctccaaagtgctgggattacagatgtgagccatcgtgcccgcctgtgccttccttttaaaggcttcctggcccctgtgatgtaagcggacctggtgtgctcacttgggctggcccccgtgacgtgagtggaccccgtgatgtgagtggaccctgtgatgtgagtggcccccgtgatgtgagtggcccccgtgacattagtggaccccgtggcgtgagtggcccccatgacgtgagtggcccctgtgacattagtggaccccgtggcatgagtggctgccatgacgtgagtggcccccgtgatgtgagtggcccccgtgacattagtggaccccgtggcgtgagtggcccccatgacgtgagtggaccccgtgacgtgagtggcccccgtgacatgagtggcccccgtgacgtgagtggcccccgtgacattagtggaccccgtggcgtgagtggcccctgtgacattagtggaccccgtggcgtgagtggcccctgtggcgtgagtggcccccgtgacattagtggaccccgtggcgtgagtggcccccgtgacgtgagtggcccccgtgatgtgagtggaccccgtggcgtgagtggcccccatgatgtgagtggcccccgtgatgtgagtggcccccgtggcgtgagtgaccccgtgtgctcacttgggcctgttcgcgggcatttcgtggtccccactgtttccctgttggggtcactgctgtaaagggtcgccccgccatggtgttctgtctgtgagattgtgccctgtttctggcagttctcaaatgctccagctgggtgatttcccccccccaccccaacggagttggcagtttcagggctacccttgtctgccatctctggctggcctgaggctgtgctggccccggtcgccctccatggtctgaagccctgagtggaagctctgccacccacagccagcctcgttaggaggaaccaggagacatcacgcggcccaggtgtctgtgcgctgtgctgggtgggaagccacctctcaggtgtgtttcccgtctccacatcagcattttgttcatggagtctgctgcttctgagcactggggacaagtcgcggaggccctgccattccttcctccgggttctgcacgcaccgcggtgaccacctccccccgaggtcctctccccgcaccttcccaaaacgtgttccccaggtccttttctgttactgctgttgaattcaacagctactgaccacctgtggccatttaaatgtaaaatgaaagcaaaataaaattaaaaatccagcccatggcaggcagggctgcctctttttttttttttttttttggagatgcgtctggctctgtcgcccaggctggagtgcggtggcacgatcttggctcactgcagcctcaaccttcccagctcaggtgatcctcccacctcagcctcccgagtagctgggatgacaggcgcatgccaccacgcccggctaatttttgtattttttgtagagatggggtttcaccatgttgcccaggttggtcttgaactcctgggctcaaatgatccacctgcctcagcttcccaaagtgctgggattactggcgtgagccaccatgcccggccaggcagcctcattttcattcacacatgaccaatggctgcttattgggctgcacgatggttatgctggctccgtcctggaggagtgagtgccctcaccctcaccctcaccctcgccctggtctcaccctcgccctcaccttctccctcgccctggtctcaccctcgccctcaccctggtctcaccctcgccctggtctcacccacgccctcgcccttgccctggtctcaccctcaccctggtctcaccctcaccctggtctcacccgcgcccttgcccttgccctggtctcaccggcatgagcagaaagacaaggcccggggttgcagtgtctgtgctcagggtccagacacagctcagaaccgaccttccttggggagtgacagtccccggaggttaggggctgctgtggccaaagagccacagatcggaggtgaggaaggtctgcccgaggtgaggaaggtctgcccgaggtgaggaaggtctgcccgaggcaaggcaggcccgcagtcccgggcggtggcatcagggtgagcgccctgatagcaagggacctatggcgcccacaccggagggcgggaaaaggaggaagagcatggcccccgtgaagcccctcgggaggaagggttcctgtccacgttcagcacccccgtgcagacctcaccattcccgacgggaacacttgtgatattcacttccaaccacacgagggtgcagctgggcaaccgcagcttttggaaaaatgttgaaactggggcggcttctctgggtgactctgacgctctcattgcttcacgtttaatttttgtgtcctgctgtaactaccatgtagtgcacttatgaatcgtgcatattttactctaaggcctgtctgtaaaccctaataaatgaccctactcaggtaagacgtcctgacagtgaggtttttaatatttacaagccacagaattatttcctgcagccacagagacttccttggcgggaaaccaggtcctctgacctcacccggctctgcagtctgttttgccgttttccgcctcaaaccccctctgcgatgtgcagctctgggtgtctgatccctcaggggtcctgtctcccctcctctggccccctccctggctccttcgcctgctgcctttttcttccatgaggatgcggttcccgtgtcccccaggacagcttcgtggccggccgcctccatggattcgggtgggcacaggtcctgcagggagctcctgtgttatctgccctccccgcgaagctccttggaggatggagattttaaggtcttactgtggtgtgagcgatcagagaccccagtgtttaccaggtaggctctgggctcagaccccagcgccccacttgttagctgtttgaccctggatatgtcattcacttctgcgttcctcagtttctgcacgtttaaaatggcagaggcccctttggtagtgagtctgtgtgacaggcgatggggccttcctctctggtacagcaggggcctaagggatgtttgacctcagcaggtagagtatcatctccgtggtacagcaggggcctgagggatgtttggcctcagcaggtggaggatggctgcaggtcaggattttgcatcacaaacaacactgctgcagtcacattagtggattttgttattatagacaacactcgtgtctataattccaaggacccattctccatgcccagaggcacctcagtcccacagaccgcagcctgattctgagttcgcagttggccagtgttgcagaagctcacagaggagtctttggaaatgagaatgacgccaccattctcttttaattgtgtcataggtcttccttccttttatacataagttaactgaggctggtttgctttccacagccagagttctaagacaattttaagtaacacttttctttcgctatttctttatgaatgtgttgggttttagggatcacagatgtgcttgggcaaccaaggctgcctgtgtctctgtgctctggggggcttttcctacgagctttgcgtgagatgccagctgcccacaggcaactgggcacagagagcaggagaataaagcaggccagggcatcaggtggggctgattccatggagggcaacggcagtggtgggggcaagtgcggggtgggtgagtggcagcagccacccacagaaggacgcgctgtcccggccccgcatccccaggagtgcgtgtgtcgcaggcgaccctgtcctctcacccaggagccctctgagctcgcgcctttcttcaggtgtctgcgatatcatgctccccttgtgttcctcctgcctcctggctgctgccagtgggtggccccccaactcctccaccagaccctgactctcagaggactccaagcctctatttgtgttattcctatccagtccatggggttcagataccaagtggaacttttaacaaccatgaattcctaggcctcactctcaaatcatcacatcagaatatccaggagtggcccgagaagacctgcgttgtagcaagctcccggatgtttctcttgcatccatctggcactggtctgcacactggtgtttggaacccccagacttgaacttagtgccgtgcggtccagcggccctcctgtccatctcagtgcagagaggggctgggggaggtgcaagcgtgtcatcctagaagaattcctctcgactaacagcctgccgtgttcttggcatctgtgcacagtggagccccacaagctggctgaacccttggcttgcgtcctaagctctgtgtgctgttaggatgatgataacgaccacgatagaaagcaccttgctgagcccctaggagtagaaggtggagggcaggccagggcagagttgagctagacagagtgaagaacacaagttctggggaagcagggaattgtaaccaaagatgaaaccacccctgcccagcggcaccatttgtagggaccttggagagttggttgaacatctgcagagcatggggtcggagactcaggtcagactaaactggttcagagccaggatacccctttcgacctgggttacatttgtcatcattcatgtaaatgtttctgttagatggaaacaggttcaaaacccactacctacttccattctggctctaatagagtatcttgtagccaactgatatttccacaaagagcaactgtaaaacctgggtaaaattttgtttaaaaatatgtttgagggattgagaggctgcagaggcagccaggacttggggagccaggttctggaattttacagaggtgagccccactttctgcatttcatggtgaggtattgaacgctttgccgctgaggtcaggaacactgttctcatttctattcaggattgtgcttggaggtaccaggcagacaacaagacaagaaaagaaaagtcttaaggattgaaacagtaagaaacacaggtatcattcattatttgtagacaatgtggttgtgtatgaagaaaatccaaattaagtaacagtcagactcttaagctgagtaagtaatttagcaagatcaatgggcaggggtcaatatactaaacttaattgtattttagtatttttatatatatcaatgatgtacaattggaaaatgaaatttatagatatcacttataatcacatcaaaattgagtacataggaataaaatcatatctaataaaagacgtgcaagacttctaagcagaaaactgcaaaatgttattgaaagaaattaaaggggccaggcacagtggctcatgcctataatcccagcactttgggaggccgaggtgggtggatcacgaggtcaggagatcgagatcatcctggctaacatggtgaaaccctgtctctactaaaaatacaaaaaattagcagggtgtggtggtgggcacctgtagtcccagctactcgggaggctgaggcaggagaatggcctgaacccggaaggcggagcttgcagtgagctgatatcgcgccactgcactccagcctgggtgacagagcgagcctccatctcaaaaaaaaaaaaaaaaagaaagaaattaaagtagcatgaataaatggaagaatattttagttcacagattagaagacaattagtattataacaatgttaattctctctaaataaacatatagatcgaatgcagttcccaaataaaattccagcaggtttttctttatttaggtgtgaacattggcaggctgcctttacattttatatgaaaatgcaaggggtgaggaatagtcacccaactttgaagaaaaaagttgaaagctgatactgccaaatattaagacattattaaagtgacagtgattaacacagatggtgtaaacagaagagcagcagcacagaatattgaatccagacagaccacacatctgcagtctcttgatttatttattgatttatttatttatttttgaggcggagtctcgctgtgtcacccaggctggagtgcaatggtgctatctcggctcactgcaagcgccgcctcccgggttcacgccattctcctgccttagcctcccgcatagctgggactacaggcgcccgccaccacgccctgctgattttttttgtatttttagtagagacggggtttcaccgtgttagcctggatggtctcgatctcctgacctcatgatccgccctcctcagcctcccaaagtgctaggattataggcgtgagccaccgcgcccggccattgcagtctcttgatttatttcttaagtgatactgtagcacagagggggatggacgtcctcagtaagaggagtggatgtgattggctgtctgtgtgggaaattatgaatgctgatacctgcctcacaccatatacaaaagttaattccaaatagatcacaggtgtaaatgtgaactctaaagtaatatagtctctattctcgacaaacataggaaaatgcctatttcagagtaagaaaagatttcttacgcaaggtttaaaaagcagttatcaaaaaagcaattatcagaaaggaaaaggtcagtaaattgggctacattaaagttaagttactcttttcatcaaaatgaaccatgaagagatcgacacggaaagccacagtgtggaagcagatgtttgcaatatgcacatccaataagaaacttgtttctagcctatacagagaactacacaccaacaagttaaaggagaatctagtagaaaaacaaccaaaagatgtgaacaggcatatcataaaagaggatagccactagacacagaaggcttcctgcctctgggaaatgccaattaaagccatatcaggacgccactctgtatccacaagagtggctaaaattctactgacagacagtatccagtgctgacaaaaccatggagcaaccagaagtcacgtgcatttctggcaggtgtacatttgtccacatctacataattacagcaattcctaagaatatgtccaacaggagtgtgtattgtgtgcactagaagacatgtataagaagctcattgtcttatgttcagtttagccccaaactggaaacaacccaaatgtccattaagagtagaatttattaataaatcatatttcatcatatatgtataccataacccagcaacaagaatgaacagacaccctactgcaacaacatgggtgaatcccacaatgttgaaagaagccagacagcaaaaaagcacatattgtatatttttatttggacaaaattcaacggcaggcaaaactaatgtatggtgacaagagtcgggatggggcaccctggacggtgggaacggcctctcagtctgggcactcgctgccgtcactcacactctgtgcttctgcatgatgtgcattataattggacaaagtattcacataaagaatggtgtcctccaaggaaaagaacttaggtgccacctactctatcccagatgggccaaggtaaccgagtcgcactgtgcagggagggccttcctgtgtgtgtgtgtgtgtgtgtgtgtttcttttcctgaggacacagccaccctgctgtgcagggacccttctcccagactcctcttctcatcttgggtgcaggttgacgtttgagaagcaaagacaccaagggtccccttcctcccacccaggcctcacgtcccctcagcgcctcctggccacgcactgttgattcctaaggtctgctgccctctgcaagcactgctcctcccgtgtcctggcctccacctgcccctgccctgggacaaagcatcctcctcgcccccaccatgtccacgcagcagaggcagatgtccaggcactgggggaacgtggtgctggggcctccccgccccactggtagagaggagccagcctctgcttgcagaccatccctcacgctctgctcctgtccagtgagctgtggttgcacccgcaggccagtgggctgtctgcccacatgggtgggggaccatggggctcccaaggtcacgagccctgagtggtttgggtctctgtcacagaagacgcagccagttggaacattcctgaaactttatgagaccgctgggccttttttacttatttgggccaaaagtgagctcattggcctcaaactcagctgctgggaaactggccagggcagcccctccaaggccaactgttgcggagttggcagctgatggggcatctatgggctgtgtttgtgccctgggtgcgagggacatttctggggtggctgccagcttgagttattctaccccaactcctccggcaccatcaccttcatccctctggtgactctggggactgcttcctgctgaaactgggcagaagccacaccaccctctccctcagacacaggccacagatgtgggcatagatccgagctccgtgagccctgggtcctcactcctgtgagcagatccaggtcctgcctcacggttttgggcagtgcagcctcgggaatgccatgggccgtgggggggcggggaatcacgtggccctgccctcatgaccacagtcagtatgggggatcatgtggccctgcccccgtgaccacagtcagtatgggggatcacgtggccctgcccccatgaccacagtcagtatgggggatcacgtggccctgcccccatgaccacagtcagtatgggggatcatgtggccctgcccccatgaccacagtcagtatgggtagaggaggtgctaggggctctttacatcctcacgtcagaggcttttttagtccaggctttgcaccttctgagtcagtgttcccgaaatgtggtaggagaggagacatggggctgagggggtgtggacgagtgtccacctgggccctgcatagggggcaaggtcgtggtgggggctgcgcagggcaggaggctgagtgctggtgtgtgggcatctggggtcaggtccctgcttggtgggaacattaggaggccgccagggtggacgtggccttaggggcagcacacgtggtgtctgagccaggttcccctgtccgtgctcacagctatgtgactttgggcaagtgactaaagctctctgtgcctggagaggatcatagcaccagcctcacgggatggtcgctggagcttgatgaatagctgtagggctgttggcacagtgcctggtccatagcacagctgaggatagtctctaaccctgaagaagcatgcctcctgcctgcaccccgttcccacacatgccctgtgcccgcaccccgttcccacgcgcaccctgggcccgcaccccattcccacgcgtgccccatgcccgcacccacgatggtgagcatggctggggcaggaggaaccagcgctgccttcctgcccaggacccacaccttctgcagctgagcgacagtgactgccccattaacaccacctggaaaccagtccgtccttctcgttgagaaactgatttcctagtatgcattttttgaatcgaataaatttatgacaccttagatttcacttgcaattttgacttctaaaaaatgttttagtcgttggtaactggtttctcattgaaaacggatgcctatttgtgatactggtgttcccattacaatgtaacacaaagatttaaacgtagagtgagtggaagccccacacaggcaggccgggcggcatccagtggcatcgggcgcctttttcgtggctgcagcgtcagcctgcactgccgggtgtgaggcagacgcgcacttaacggcgtgagaagccagatgtgggaggcaccgggcactgtgggcagtgaggcaggagcttggccgcgtgtggggcagaagctccatggctagaatgggatgtgtttgggtcacgggtctgggggagggtgcgttctggctataactggatgtgtttgggccacagaggtctggggggtgcattctgcatccagcagctctcacatggcagtcgtggtccccgttgctggtctgggctgttgtggagtagcgggggcatttgtgggcgaacccagaggctgaaattccaccccaatcagagctctattccagggaaaaggggagaaattgagtcaggctttgttgttctgcaaaacagtgacgccgctcaggcagcgctgcgggttacagcatactcagtggcttcatttcactctcacggtaaccgctgggggtggattctacgattgtcctcatttttacagaaaaggaagcagagatggttcacagccaagtcacctgtccagggtgatgcctttgcggggcccaccagagcccgccagtgtcgcagaggcggtgagcccctcccgcccaacacacagccccttggcaggggctcttgagcaaacctgcaggtgggcagcttggggcgtttctcagctagcatcacccctgcttcaggacttgaaagcatttgactgggttcgctggcctgaggattacgtgctcggtggaaattagtcattctgggctcttctctccttcactctaggaggactgggacccagagagctccgggatcagctccctggcttggagtccaaaggcagctctgaccacgccgcctggggcaagagggagggcagctgggttccatctccgtggcctggcacatccaaggtccctttgtggaaaaggcacgtgtagcacctgttactggaggataacctgtaactttgtgcctctcccaagggagcacacaggtctacacgggaagtaagattccctgtacccactgtgtctcacagttcagaaaaagtcgtcaaagtgctcagactcaagaagtaaataaggaaatatgaaaacatgactttatttctttctttttttgagacagtctcgctctgttgcccaggctggagtgcagtggcaccatcacagctcactgcaacctcaaactcctgggccaagcaatcttcccacctcagactccccagtagctgggaccacaggcatgcgccaccacactcagctaatctttgtatttttcatagagacagggtctcatcatgttacccaggctgatctcgaactcctgggctccagtaatccacccaccttagcctcccaaagtgctgggattgcaggcgtgaaccaccacgcccagctgaaaatataactttaaaaaaaatcttagctccgtaagaactaagccagatcagaaaacgaattctgtctgtggcccccacagctgtgaaatggagtcgctgactcgccatgctcgtgcacgtgcttagtgcccactgcagaaggctgctttgaatgaaagctagtgtttattcgtgtactcacccagaaggtttctgctgttattgaatcaaattaccctacatgtgaggcatttttcacggccagatgcagacagggacacagacgcagcagcacccaccacacatgaacgttcgggggtcactgcctcgtcttcatgtcttgggagttgctgtttctgtctttaaatccgagcgtcagaaggatctgagacacccgatataaatccctggcttgttaatgatgctcacagagagcggccacgcccatagactgcataatttatctccatcctgcagaattctgattttcatgtaaacctaggacatgttcagagacttggaagttagcgattctagcccctgccttaggcatgcccgtgtggttgtttctgctttggattggctggtggtagcagctgctggcatcacgcaattggcttggctgcagagtgagcccacggaagagggctctccgcaccgactctgtgactcaggcttctactaccaggctcatccgaggacggaggctgtcgttatacaacgcgcaagtgtggtctctgtcacagatgtggctgtcgcagagagtgctgcctcctctcccgtttccagcagatgcttgggaaccttcagaagtcttggggattttctcccagcaccgtagccatgccaccacgagtgaatccttaacgtggaccagcacgggcacctcagatgccaggaccggcgtgatgtatgcgccataagactgttttggagggtttagtcagctggtcacccaggaaaggaaaatgactcggctcttactgtggaatagcaaatgactgagctcgggagagatggttctgcctcaatctgtgactcgaggtggttggtgttaggctgagaaataagaacacaccaaaagtgcctgcccttccgtagatgagagcaggttctgggactgcggggatggggctgccggggcccccgtgtgccatgcctctcacctggtattgcagaaatggcatcatgaatatgggggatcgctctcccaagaggttttctgagggatttcgtgggcagccggcttcccacctgcacacattaacggcggcgtctcttcctcactgcagcctgcaggacgctggcatcggattcatcctggtgatagaccggcgacgggacaaatggacctccgtgaaggcgtccgtcctgcgcatcgcagtaagtgccacccggggctctgccctgcgcccggcccctccctgggctgcatgaccgcatggtgcccttcctctgtgtctgccgcagttcctgctttgtgctgagtgggacagagcccagtcccggcgggtggaggccggcgccaaggccccccctgcttgggctcccaaggcactggtgcctgggtgtgagttttcccagatgaaggaactcttagggagcccaatgtgacttgcaaacaatttccccaggcagagcagcccatatgtttccgaacaccaagtctgagatgctcgggactgaatatgcctcttacatatttatacattagtgattttctcctttccaaatcgggccatctatctttagctgtgacactgaacgagccaccaccgcctcccttccccagtgggattgaacatgcacttcctcttacacaaagcacaacagtcctgaccaggcaggacgggggctgtgtgcagagacgctccaggctggaagttggaagtggtactgcacagctttcctatgtgattttctcctttccaaatcaggccatctagctgcgacactgaactagccaccaccgcctcccttccccagtaacccagcctcgcatgtagccaccctcctttccaaggactttcccttggcatccgagagtctgtttgcagattctgcacgctgccttccatagcagaaggggagctgggtttgctgttggttttaacccagagtaatcatttaagagggaagagattaagtcagcagaagcccccaaatcttatttttgtcggtagctcccacccgtatgcatgaccccggcatggagcatttttcacccacgctcgctctccccgcctgtccgtccaaatttcattgctgccaaaggaccaaaaaaggctgcctgtctgccaagaggtgacccagagcctgggtccaggcacctgcatgttctcacgcccgccacagcccgtccctcccaggctctgggaccctgggtcctcagctgtgatggcacaattgctccaagcattccccagcaccaaaccccagtgaagtcagattctcccagtgaagtcagattctcctggcctttcctgggtcccgcgttcagactacctttgggttccccagcctctcggtggctgctggctggtgcgccaaggtttgaggtatactgaaaaaagtcattcctttccccgcacattgcctcattccttcatcttttacaagaattagaggccccatatctgctccgatgcccacaaccttcatcgttttggtgcaagcctgtccctgagccgctggttctcatcgaagtctttaggatgaggcatctccttgcacccccacggcacctctctgcccctcgccgcggcggatccccgttcctgaccctgactcaacctggcacacaccacctatggcatcgttatctgaaataattcaaaacgcttcaggatgcttccaaaaaagtagacgtgtatagaatcggtcttcctttgttttaacagtgcgttcgtttgcttttgcgtcactataaagacgtacttgagctgggtaattgataaagaaagaggcgtaattggctcacagttctgcaggctgcacaggcttagcacctgcatcttctcagcttctgagggggcctcagggagctgccagtcgtggtggaaggcagcggggagccggcatcacatggtgagagagggagcgagagagaagggggaggtcccagacttttgaacagccagatctccagtgaacttactgagcgagaactcacccgtcaccaaggggatggcgctgagccattcataaggggtcacgcccagacttaatcacctcccaccaggccccacctcagcactgggaatcgcatttcaacatgagacttggaggggacaaaaatcccatccatatcaagcatccccagaaatgcagaaagttctttagataaaagccatcaccagctaacagccatgtgtgcctttcattattgtacgtcttaaatgagtttgcacatgaagtcataggcaactctaaaaattaaatcataagaacccacggggtcagacacacatggacggacaacagatactcttgggaagcacccatccgtcctgggcgggtcccacaatgctcccagcaggcacgtcgtcgtttaaacaacagacaacaccgttacagccgcatcttttatgcttacctgccgctgatataaaccagccatcaggacgactcttagcaacacgtgggtgtaggagtcggcctccctgccagggcacttgcggtgtcaggacgcacctgggtgcctttcatgcccgtggggtccaggcacctgcatcttcacacacctgccacagcccgtccctcacacggctcatgcctcactacatgtgccccgtcccctctgctcacgcctcgctacgtgtgccccgtcccctctgctcacacctcgctacgcgtgccctgtcccctctgctcacgcctcactacgcgtgccccagagcctccgctgatgcctcgctacgcgtgccccggcccctccgctgacgcctcgctacgcgtgccccagtgccctcgcacacacatcaccacgtgtgtgtctcagattaatcagtcactcccgggttagatgacaagagcttccccagatacgaggttactttttaagaaatacaaaaatcattttctaaaagcaaagtatttctgcgaggtcaccctacaggatagcgaagcagcccacagcagacccgtgatttaggtgtcgatcttcagctgccgagtgtcctgttccgttcaccgagtgtgtgatcggatgaatttcttaagcaggttggctcatcttgaaagctctgtcttgtgagcatcataactgaacagttagtgttttagtttttatttttgcattgattcttacaccataaaaatatggctttttctgtccttcctttaattctcagaattgaccaacattggtttggaagtaacagaagccagcattttccagcaaaatcacccagaattctctctgaacaccagtgctttcttgctataataatttacggtctttttttttttttttttttttgagacggagtctcattctttcgcccaggccggactgcagtggcgcgatctcagctcactgcaagctctgcctccccgggttcacgccattctcctgcctcagcctcccaagtagctgggactacaggcacctgccaccacgcccggctaattttttatatttttagtagagacggggtttcacccacgttagccaggatggtctcaatctcctgacctcgtgatccgcctgcctcggcctcccaaagtgctgggattacaggtgtgagccaccgcgcccggcttatggtcatattaatacacagactctgtgtagttagcacgtcctgaggcttttctctgtcccaggcactgcctgggcatcacggatgtgagggaggaagtgagcaaggctcaccgccagctgggtgaggacagttgaggggcatcacaatggggtcacaggcaggggcagcagggagcagccaggagggtggctgagccatggggagggggcagagttaggccccacatgccaggccccatccacctgggctgtgaccctggagagggcgtcttcctgtccccaggcccctgctacccaggagcccgccgcctccagaagggtttggtgcaggaggggcatgagaaaccggcaggagatgatgatggtggacattggatgggccaggagacatggagctcacagccctggtttcatgaaggagaagtgggccacaaggccaaggaggcaggaggcgggcagtggtggcactgtcataggagctggttgtgcatgtgctgaggcttagagggtcactggtcaagggagtgagggcagctgtggacccagccaagcctaggtcctgggcagaccaggaggggtgagggtctctgcagtggggaaggggtgggtggtggggctggcggggaggccccaggctctgtccatgagccacgcactccttggagagggcagaccagggatgaccccttgggcatcttgattcagttttttggaaatggtgcagttgacctgacgtggggacaccaagtagtggctgcagcggggcacctggacgccaacccctgggctccaggccttgacagcgagctttggctggcctaggcttccacctaaagtggctttgggaaaactagcacttagcaacagtccaggccagccgagccctcaagcaggtttccaaacaggcacaggctccagctgcccgaccccaccagggtgcccagctcatggtgctgcgggcgccacaaagcaagcccgtggcagagacttgcctccaagcgctcggccaccgaggaggacgcagcgcttacataatgtgccgggatccggggctatttttagccaccatatgtgctgtcttaagagctgagctctccctaatttggggtgttcttttttcttttctggatgccttcagcatggcttggaatagaaaaattagacattggaagagccaaaatccagtgttcctaaaaccaggctcccaatcgagagcaagacccatgtgatgctgagggcgtgtgggagaaggataggttcacagctacccacccagggggcagaaagatgagatcctctgagaactcacgtctcttctcccttaggcagttgtgcggtcctcagatagaagcatcttttataaaatgctgttgcaacatctaaccctcttccactgtactgcatgtgtgagtgtgtgagtgtgagtgtgtgactgtgtgtgtgtgcgagcgagtgggagtgtaagtgaatgtgagactgtgtgagtgtgtgagtgtgtgcgcgagtgggagtgtaagtgaatgtgtgtgagactgtgagtgtgagagtgtgtgtgtgtgagagtgagtgtgtgtgtgcgtgttcacattttgggaatttgtaatagagtatatatattcatgtttagagctagcctaaatcaaactaaatctagatcctcaagtaggtggctggagaaagtgaatctgatttttagactgcatggggccacaactctctttcctgtaacgccggtgcagtctgtgtgtgcaggaaaggtagaaaacaaggtgtctgagggaccccggacttctaggtcgtccagcaaatctttcacatttgcaaagtacgattgtatgcggcccccctgtgccagctactggggctctggggaggagctcaccgtgggggcggtgggggcggtgggagccgtgggggccggggcggtggaggggggggtggctgggggagcggggaggcgggaggagcagggggggcgggggcggggggggcggggggagcgggggggtgcggggggcggtggcggggggaggggggcggcagggggcggtgggagcggtgctaactccaggaggacttcccggcggaggtgatgcttggtgagagcctgacgggaggaggagttgtccagatggaggggggcgaggagcttcccctgggaacacaaagcagctggctgccgagggagagagggccaggtccgtgtgcccctctcggaagaggcgagaccgtcccccagggcagggaactgaaatgcgcgctgcataactgcggcgacacgggggtgggggacccagctcttcccggtgtggctgagctttctcagaacaccgctgctgtgtgcagcaagcacctgcccaggtgagcacagtccccccgtggtggacagaaggggaccaggatctgcaggctgtctcctccgcaccagctgctgtggcaaatgcgtttcagcgcaccctgcgcgttcaccaaccgccgattacaggggaggagctgggcttcggggcgacgagggaagctgccgatggggtggggcggctctgggggcggcctgggcctttctgtctctgaagcccgagctctctccctactccggtggtcccagggccacggcggtgggcggtgccggtcatgcagaatattgcagggggaggcagcccgtgaggcttccacgacgctgagagcgtctatttaaacgactgtccttcatccgagggttcgctcctcccacctaagggtggatttgacagccttggggtatccagcaggggtgggagatccagaggccccaagcccttcttcactgtgtatttcctggaacatggaatccaagggtccaataacgggcggcacgagccactttgctctctctaaagacctcggaggcgacacagtgaataacaaggttgtcttagtccgggtctgctgcttatatgtcaagagtatctgaaactgggcactttacaacgaaaaagaattcatgccttacagttgaggagcctcacctggtgagatccctcttgctggtgggtcctgaggcgacgcgggacctcacctggcgaggggagagtgagccagcccagggctgcccccgctgcttacaaagccaccaggcccccacccacccccacgacagcccgttaatccgagaatccgtgaatggatgaatccattcatgagggtggggccgtcctgacccagtcacctctgaaaggtactgcctctcaatgctgccatgagtttcgaagtttggtagggacgaacattccaaccacaccaaatgtatatttcagaattgctaaaagaatccattttaaatgttctcagcacagaaaactggtgagtgggtgaggtgacagatcggttaattggcttgatttaatcattccactgaggatacctatagcaaaacatcactgggtgccccgtaagtagatacaatcatgatttgtcagttaaatgtagaaacatttttttaaaaagataaacagagaaaaagaaagagctctgagacccgggctcgctcagcggttttttctcgcagagaagaggaaggagcccgggggtccctgggaccaggtgcctcatgaggctccgtgtgggccgtggaccctgcaggccacgccggcttccctgactgataaacccagagccaggccttgccggtgagaggccagggactgctggctgagcttctccagcgctgctcttcactcccctggatgcctggagcgagactatttgcctggtttatttttttcagcttagagctcgttgcacggagtcagaacccctgcatcccggtggctcaggcatttgagtgaaggtcggatcaggagggaggggagatgcagctgccccacgcatggaggagaagagctgtgagctgcagcagcctcgtgtctttttcctctcaactttcagttcagaaaaatttcagacctacagaaaacttgggagagtctcacagtgaacaaacctcagctgtggccataaacaaagtgcccattcgtgtgtgtgtgtgtgcgtgtgtacaaaaacacacagacatagacacagacatgtacacacatcacacagacacatcacacagacacaaaacacatcacatagacacatacacagacacacacatatatatacacatatacccacacatacatcacataaacacacacacatatcacacagacatgcatacactcagagacatacatcacacaggcacagagacacacatcacacacaaacacacacatatatgcacatatacacacatcacataaacacagacacacacacacattttgctggtgagagccggctctgccatcgtgtcagttcatcccggattgctgacatggtgtctcctgagtggagctgccctctgcataaccacaggcgagtctgcatcgcggccacactgccctctggatgcccacacatggggctttctccacgtgccccgtcatgtccttcctgtatttgttaaaatccaggtccagtgaaggacggcgcccccgtcagctgtccacccttctcagtcgtctctaatccacccagttgttggtttttgttttgctttctgtcttttgtgagattgagatttgcgaagggttgaagccagttgctttatggaatatcctttcatctggtttccttgtaattaggttccacgtggtcctttggggcgggaatcctggtgggtgagcttctggggcagcccgtggaggcccaggatgtccatgtgtcccgtgattggggcggtgttgtgtgctcagacggccaaggaggcgtccggatttccccaggagaaggtgcctctcctcttggtaatcagtgggtcatgtgtggtgatgctcaggacggggcgaaggtcccgtggctgaggtgtccactgaccgtttctgcctgaatgggtggttcggtggtggttgccacagggctgtgttttcaaggggagcagcaggtgcctggcgtctgcatccacacctgcctggagcctccttccatttgttactctgtctcctcctgtgtccctgcagctgtgtctccagtgatcttgcctgtactctccgcctctgcagagtgaggttttcactgattgcaaagtaaacatgcacgccccttcagggtcctggtccttagggagctggttaacaagttgaccagaaaaacaacccgaatactcctcaactcttgatgggagctcagttcacacggctccgaatcggcgaaacgcaaccaacgctgggcagaaccttggcacaactttgctggtgtctgctgagaagccgaggggaggttctggggcttggcttgagctgcggggtgagtgtgggagagacggcgagctccctcccatcaatcaatcaacagactgtcctattttcatagtagtccccacccaaatgtcattcgagtccaatctcaggatcctggatgcacgcctgttctccaggtctgcttcccgtgaaattcgtggagattattgtacattcgggagtgggagtgcgattggatgtgtgtctgcagattctccctgtattttctcccaggctttctagaggaccatttgctagaggaccagtccccaaacggccgcgcttttaggattggttttaggagtgatggcctcacgcacacggcagcggccattctgagcactcgtgtctgaacatctgcaggaacagggtccacgcccattgttttcctcacccggtccagcgtctctgattccggctctaacgtcttcttcatctgttaacacagagacacaaacaaactttcaaatgcatattttttatataaacttgtgtttactgtttggctactgtcagacaaatgtagttggtgaggtttcagttgctctgaaattaaatatataatgtcaagctggataggtgtggcttggagcagaccttaaggaaggtgatttgaacttggggagggtttttcaaacagggttccccaaagtacccagttctacaaagttcccagcatgtcctgttgctttagctgcattggtaaatacatgcagcgattgttttctgagtctctaagaatattaactcagaaaccagtgaactctttttctatctccagactacagtgctgtggtcatcacacatatctgttcctaagttcatccaggtcagcccagaaaatgagcaatattgttttcatgttagatagaaacctataggattactttactgttgagtaatttacaaaaagacttgacagcctccatcccaaattcttcatccagttaccatttatacttacccccatcttttaaaataaagtttttattttagaactttccccagcttttaatacaaacggtcaactccaattcagagaaaattttatttgctgttatatttattcaaagtatgtgtttgtgtacatcgttagcaccttctcactcagctaggatcttccaatttattctatttaatataatgatccaataacttaaaatacgaaaccctaaaactgagccaaggaagagggggtcatgtttgatgctggcagagcctcagggaccagccttgctgcaggggtatgcttcactcccagaggctttaggggcaaatagttgcacctgctggagacgtggacccccccccccgccacacacacacacacacacacacacacacacacacacacacacacacacacacacacacacacctggcttcatctctgagcttcaggctctcagcttgtccttaaagatccaggtgataaaaacgacagtgaaacgtagaagagcgtgattcatcgcaccatcagaaaaagactggttttccgtaaatagtggtgtccaatttcacagcagtgtgagggattttcagtccgccccttgctgagacacagaatctgccctggggcgtcccactctttggggcttgcttctcgaaggaggactgcccaggcgcctcgtccaccaggatcacactcctggcagatgctcagctcacgattccctgcttgtaattcagcctgtccgtcacagcatcttacccacacgtgctccctgcagaaggtgaatggctgtggccttagtctatgtccaggcgtcgtgtgagatggtggggcagagagggcgcagatgcagggcccctccagagcacttccctgggggccgaggctggagagaatgggtgtggagagcagcggagacaggagagtcccccggaagccatcagcctcccctccctcatccactccgcagcagacacccgcagaggacctgccaagtgtgccggccactgagggccgtggtccctgccctccccacgcaatgcagatgaagcagaggtctccatgggaggggtcctgtgggaaaggtgtgcagtgtccacccagtgacaggacattgtccacctgccctggacggggagggcagccgcccagtgaccgagcccttagtttatgcacaaggggcaggggcacatctctggttttaattcctacaaggcaggtgacctggtccatgtttgggtgctgagtgtttgggtgctgtgtgtttgggtgctgagtgtttgggtgctgtgtgtttgggtgctgagtgtttcggtgctgtgtgggtgtggagtgtttgggtgctgagtgtttaggtgctgtgtgtttgggtgctgagtgttttggcactgagtgggtgctgtgtgtttgggtgctgagtgtttcggcgctgagtgggtgctgtgtgtttgggtgctgagtgtttgggtgctgagtgtttcggcgctgagtgggtgctgagtgggtgctgtgtgtttgggtgctgagtgggcactgagtgggcgctgagtgtttgcgtgctgtgtgtttgggtgctgagtgttttggcgctgagtgagtgctgagtgtttgggtgctgtgtgtttgggtgctgagtggttgggtgctgtgtgggtgcggagtgtttgggtgctgagtgtttaggtgctgtgtgtttgggtgctgagtgggtgctgagtgtttcggcgctgagtgggtgctgtgtgtttgggtgctgagtgttttggcactgagtgtttgggtgctgtgtgtttgggtgctgagtgtttaggtgctgtgtgtttgggtgctgagtgtttcggcgctgagtgggtgctgagtgggtgctgtgtgtttgggtgctgagtgggtgctgagtgtttcggcgctgagtgggtgctgagtgggtgctgtgtgtttgggtgctgagtgtttgggtgctgagtgtttcggcgctgagtgggtgctgtgtgtttgggtgctgagtgggcactgagtgggcgctgagtgtttgggtgctgtgtgtttgggtgctgagtgttttggtgctgagtgtttgggtgctgtgtgtttgggtgctgagtgcttgggtgctgtgtgtttgggtgctgagtgggtgctgaatgtttgggtgctgagtaggtgctgtgtgttttggtgctgagtgtttaggtgctgtgtgtttgggtactgagtgggtgctgtgtttaggtgctgtgtgtttgggtgctgagtgggtgctgtgtttgggtgctgtgggtgctgaatgggtgctgttttggcactgagtgggtgctgagtgggtgctgtgtgggcgctgagtgtttgggggctgtttgggcactgagtgtttgggtgctgagtgtttaggtgctgtgtgtttgggtgctgagtgttgggcactgagtgggtgctgagtgttttggcactgggtgctgagtgttgggtgctgagtgggcgctgagtgtttgggtgctgagtgtttgggtgctgagtgtttagtagctgcgtgtttgctgtgtgtttgggtgctgtgtgtttgagtggtgtgtgtttgggtgctgtgtgtttgagtgctgtgtgtttgggtgctgagtgtttgggtgctgagtgtttaggtgctgtgtgtttgggtgctgagtgttgggtgctgagtgtttgggtgctgagtgttttggcactgtttgggtgctgagtgttgggtgctgagtgggcactgagtgtttgggtgctgagtgtttagtagctgcgtgtttgctgtgtgtttgggtgctgagtgtttgggcactgtgtgggcgctgagtgtttgggcgctgtgtgtttgggcactgagtgtttggatgctgagtgtttgggtgctgagtgggtgctgtgtgtttgggtgctgagtgttgggtgctgagtgtttgggtgctgagtgttttggcactgtttgggtgctgagtgttgggtgctgagtgtttgggctctgagtgtttggacactgaatgggtgctgagtgtttaggtgctgagtgtttgggtgctgagtgtttcggtgctgtttgggtgctgagtgtttgggcgctgagtgtttgggtgctgagtgtttaggtgctgagtgggcgctgtgtgtttgggcgctgagtgtttaggcactgagtgggcactatgtgggcattgagtttttgggcgctgtgtgtttgggcgctgagtgtttgggtgctgagtgtgtgggcgctgagtgggcattgagtgggtgctgagtgtttgggcactgagtgggcgttgagtgttcgggcactttgtgtttgggtgctgagtgggtgctgtgtgtttggtcactgagtgggcgctaagtgggtgctgagtgttttggtgctgagtatttgggtgctgagtgggtgctgtgtgtttgagtgctgtgtgtttgggtgctgagtgggtgctgagtgcttaggtgctgtgtgtttgggtgctgagtggtgggagctgagtgtttggatgctgagtgttttggcgctgtgtgggtgctgagtgtttagtagctgtgtgtttgctgtgtggttgctgagtgtttgggtgctgagtgtttagttgctgtgtgtttgctgtgtgtttgggtgctgagtgtttgggcactgagtgggcgctgtgtgtttgggcgctgagtgggcactgaatgggcgctgtttgggcactgagtgggtgctgtgtgggcgctgagtgggcgctgtgtgtttgggggctgagtatttgggggctgagtggacactgtgtatttgggcactgagtgggcgctgtgtgtttgggcgctgagtgtttgggtgctgagtgtttgggtgatgtgtgggcgctgtgtatttgggcgctgagtgggcgctgagtgtttaggtgctgagtgtttgggtgctgagtgtttcggcactgtttgggtgctgagtgtttcagcgctgtttgggtgctgagtgtttcagtgccatttgggtgctgagtgggtgctgagtgtttgggtgctgaggacagacttgtcaaggtcttgctactaggattccacaactgtggaaaaggcattgtataatcctaagtgaggtcccagccacttatgttgcaatcccagagctgggttggaacttggggtgcgcgatctagaattcccgcctgagatcatgttgtcagcagtagagatgagcccaggtgtccctgcagccagcgtggctggagggcccagacttggcccacgccccacgcgtcccctgacttcagaccctaccccagcttcctaacctcagggccctcttcttatggtcctcgctaggccagcctgaacattggagtgtggctggggcagtgcccaggcaggacatcctggtgagtcggtcactcctcctctagtccttgctgctatattcctttcgggctttagggcaatgccattcttttctatatgtcatattttaggtgcatttaacttagttatccagaaatcaaactcagttgcttcagtttctttttttggtgatggggtctccctggatttcagcatctggacataacttggtgtcgagagcaaccatcactgcacgtctgtcatcgcggcttttgagcgcttccttggtgcaggtgtccactgaacgccacgcacgccttggtccatttcatcttcgaaagggtgtcatgagtaggcactgccggtctccccactttcccaatggagaagctgagacacagagaaggggagtgacctacccaagttcccacgccttgtaagaggcagagccagtttccaaataaattcatgtaactgtgtccaaggccgtgtgtgcacaccagggcacaagattatttttatttttgtaggtaacacacacatgtgtctatgttgcttttataaaatttgacaagtgtcttggtttcctggggccatggtaacaaagtaactacagactgaccactgggcgcacagaagctgttccctcccagccccggaggcggagtctgaactcaggtgtggccggagggggctccttccaaggctatggggagcgtctctctgctcgaggcctctcctcagcttctggtctggctgcctcctgggtctccctgggtgtggaagcaccgccccggcctccaccagcaaattctctgggagctctccacgcggtgctgggatcagggcctgccctaatgacctcactttagcttggttacctctgtaaagaccgcgtcaccagccaaggtcacgttcggaggcactgggagttaggcttcgacatcataatttggggggacacagctcagcccctaacaactgtcgtaagctttggacttttacatttgtaagcagcataacgttctgccaagacatgaggcttttcctcttttcttttagaaaagagatgcctttcacagaggccagcatctctaccatgtttatctcagcataaacctgctgcgttgaggatgcctggccgctagctgcgcgcccccggtcagcccagcgtgcaggcaccgcactaggggggctgctgtctgcagagcacgctgcaggcccttgtctctcgccctctctcacaggcatctttcccggcaaacctgcagctcgtcctcgtgcttcgcccgacgggttttttccaaaggactctctccgacatcgctttcaaattcaatagagatgactttaagatgaaggtgccggtaagtgcgccccgcctccatcctgcggtagcagaacggaactcattgccgtcctggcccatctgtgatcatcgaaatcctcgaggagctgacttcagggccacacggtcaacaaaaccccgcaggacctggcgggaagttgcacctcctcaatgctgccagaagcagtacaatcctttcttcccccacccccgcccccagcccccaccccgccagaggtgcacagagcatcaacctcagagaggccaccgtgtgggcatcccatcaggacgcgggtcacgcgacattcatacccccaggagaactacagaacttgagaccctaagggctgagagtccgcctggcccacccgcgaggaactcagcccaggccctgcctgcaccccagggatgagagaagggctggggagggggctgtaagcatctctggacctgggagggagcacccactgctgacagggatgggccggacctgtcctggagcagccaacagggtgacccctgccccatcgccaccacactatcccggcacagggcagcatctcccaacactgcccactgagaaagcaccttcagtcctgatctgctgtcctttaaagaacaaaggcttcacaaagtcccttagagcctgtggagcccggtcaccagcccgagctgtgtagctcccccggagagccctggtcagctgccttggcgagctcacatcttctctgccacaaagagaacagagacatatgggccagcaccaggcaccgcagagcaccccatggcaccagccagatgctactggaaaccaggcaatctggggtgcaggtcgctcactgtgaagctactccctgtgcgctgggaatcaggtggcaccagccctccctccccaccctcgttgcgctacagcctcaatgccaaaggtgcaagagcccttctctgacagggaagaaaacggcctggggcctttccccatgtactgcccccttcccctcccctcccctcccccttgccctcccctcccccttgccctcccctccctcttccctttcccctcccttccctctcccccttcccctcccctccctctcccccttcccctcccttccctctcccccttcccctcttttctctcccctccccctccctcctcctcccctcccctcttttccccctccccctcctcctccccttcctcctcctctccccctacccaagacagccctgggggtcacaaggccccatccactctgcccacccccacgcagtccactctgggtgtcacccgtgaccctggtgcctggcctggggcagtaactgcaggtgcagggtgttctgcatggcacccatggggctctgtgccatcgtgctttggtggccccagaaccaccagcttccaagccattgggaaactctgtgcatgtaccgttttttgtagccttggagaagccttagtgtctgaacagtccattccctagagacgaccagcgacaaaaccgtgcagagcagggactcgtgggcagtgggaggctcatgtcctgacaccaggatgagctaggcattgcgtgtgcagctcagagctcctctgacagctcctctcgtgatggcgtgtgcagctcagcaccctgcagacagcacctctcgtggtggcttgtgcagctcagcgccccgcagacagctactctcttggtggcttgtgtgtgttatggcccttatgatggagataactccgtgcgccctccttccctgctatttggcaggcactgcacactagccataggctttgtgaccacagacgtgtcacggggagcaagaccgacctcacgggtcatccatgccacaggctcccctgcacaacggctccacagcaagccgtcaaaatgggtttcacagaaatcaccggcatcttcaaactcacagccccacttagataattcttgaaattagagtggatgatgtgaaggatgcagttgttgacacgtgtgtgtccgtgtttcagtgccgtgtgctggactcagccatagaaaggagacatgagggagaacagtggccccggcacctctgctgccgtgactgactgtccaaacccatggatggagtgacctcaaaaagggcaagagaaatgcagaaaaatgaagacaaggcgtgtgtagaggagcttatgcggccgtcgcaaccacaggttttccacataaccataaccgtgtgggaactgccagccactctccccgtccggcctcagtggtggtgtgttgatttcaactggtgtctacaatgaccgcggggtattttcggcaggaacagggacaaaaatgatcatctctcccatcagagcactgtttgatgatgttgctggaggaggtgtaaacgcctgttgcatgtccttggccatcacaggccgcactcgtgtggagttttgtgcacctccaacagcaccatttgctgctcaccgtggcatgatgagctcaggcacaacgtgcccatttacgaaggaggcagctgagacacagagtgggcggctggcctgcgggcgagtgggacccacatctgggtccacacaggtccgaagccaggcgcccctgtccacacagccacccacaatgtccaggcgcccccatccgctcagctgcctacagtgtccagacacccctgcctgcacagccgcccacagcgttcaggcgtccctgtccacacagctgcccacggtgtccagacacccctgtccacacagccgcccacagcgttcaggcgtccctgtccacacagccgcccacagcgttcaggcgtccctgtccacacagctgcccacagcgttcaggcgcccctgtccacacagccacccacggtgtccagggtttggataaaatctaggcttggctttgcaagcagtcagacgggaccacaaaatgggtctcctgaggtttagctcaggggttatttgacaccacatcatgttttattaaataccgtatcagtctagagtggggactccactgggggtgattttgccagatagtcacggcagcagaggtgccggggccactgttctccctcatgtctcctttctacggctgagttcagcacacggcactgaaacacggacacacacgtgtcaacaactgcatccttcacatcatccactctaatttcaagaattatctaagtggggctgtgagtttgaagatgccggtgatttctgtgaaacccattttgacggcttgctgtggagccgttgtgcaggggagcctgtggcatggatgacccgtgaggtcggtcttgctccccgtgacacgtctgtggtcacaaagcctatggctagtgtgcagtgcctgccaaatagcagggaaggagggcgcacggagttatctccatcataagggccataacacacacacgccaccacgagaggaggtgtcggcggggcgctgagctgcatcccatccgcacatccatccgcagtgtccaggtgcccccacccacacagccgcccgcagcatccaggcagacgtggtcctctctgtgctgctgggtgttctgctgatggggcagctcttttgggagccaacaataatcccaaacactaccacgcattccctttctcctccaggtcataatgctgagctccgtaccagacttacacggttacatcgataagtcgcagctgaccgaggacctgggtgggaccctggactactgccactcccggtggctgtgccagcgcacggtgagccgcgtcggggccagcggggctggctgataccagctcgagtacttccacagaatcgctcttgcattacaacacggccctttccaaaaacacattcacattaacagtcgttttctttcccaagaatgaggagatggtctcagtggaccttagtcattgtaaagaagtaacgtgagtcataagtttgggagtggctttctctgggcttggagaccaaaaaaaaaaaaaaaacccttgcgttgtggtttgcaacactcactgctctcaacggggagaggcagcgcaggcacaggcgactctaggtgacgggcacacgtgtagagtgtgcctggtatgtttctgaagaggtcaaggagggcaggacgctatgggagggcgttcaccgtctttgcgtcagccggtctcacctgatgggtctgtgtgggaacggtttccgccggtgtctgctttcagggcagcaggaggtgggtgcagtgcacaaggcatgcaattgtgttttctctgtccccaaggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggtacatggggggtgctccggctggaagctgtggggggctccggtcagtcagaagctgcgcggggctccggtcggaagctgcggggggtctttcgtcccagcgggagtttgtgtcagcagcacgtaagaccaagaagtcagcaggcttgagatgccttttgatggcaattagctcggcaacctctccgacgagaacggaataaaaggagtgtaaatgaaccctgtagattgctggctgcgcctgccattctggcgttgggtcaaccattggccctgggtggccgtggcttcaggagtgggaccaggggtggctcctctcaggagcacttttggctgtctgtgcggggagctcccgaatagacatctcttgcttctgagtgtgaccgagacaggatgtctgtgccggtttctcatgccgagcaggcgatgaagtggcggttggaattcctgtttgcagaacactcccagtgctcacgtgtccacagcgcttgctggaacaaacgtattctgaggagcacgtgctccctgctctgtgctgcccctggcccaccggcacgctgctggctttgcagcaatggtagcccagggccatgacctgctggtgtgtccccgaggactgtgcctctgtgctcaccgggccgctccaccgtgaggacactgaggaccaggagcaggcaccatgagaaagcctggtctccagtgactctttcaccttaacccgttgccctgagtgccctgtaatggcagctctgccccggggcacacaggagtgagggaggcccccacatcaccccgcctgcccgcacgaccccacagaagagactgggaagactcgggggtcggggattgaccccttcctcagtccccgccccctcaagagcaaggccccacgaggcctcaccaccagcctgcgctgtgtgcctggacggggccgggacatgaggctgcattctctccacaggaggatttgaggctggcactgaaagaggggcacagtgtcctggagagcctcagggagctgcaggctgagggctcagagcccagtgtgaaccaggaccagcttgacaaccaggccaccgtgcagaggtgaggcccggctgccttcctgccctcatcctgtcccagtccatggcaggatcctctcaggcacacagcttctgcaaaagaaacaggccacggaaatagcaagcagcgtggcaggcaaccccactcctggccagggccagcacagcagccggcctccgagcctctgtgtgggcctggctcctcctgctgaaatgcttttctctcgaaccccacagaaagccactgttttggggacaatttcctagagcaaacgcccttttgccggcatgaaggaggcgttaggggaagcagaggcgatgggagtgccttagacctggggcttctgcattccaagcggggcttccacagacagggagaaagcctggggttctccttgctgcagatagtgtttcttactttcattgtgaaaggtgtgattctcatatttctcccttgggcttccagctttatagcagcacagggtagggcactcgtgtggttggcatggtgctctaggatgtccagaactccctgagcatccccctcaccccccgagaactccccgagcctccccccgtcccatcctccccaagactccccaagcctcccatgtcccatctcgctggtgggtgctatcagccctgcctccgagctgaggagcagggcccgcacagctggacagcggcttgtccggcagggccgtgcggggcgcacccaggcctggaccaagctggtccttttgactctcagctgcctttgactcccacgcagcgtggcccacaccctgagctgccttctctgccagggacatgccaagggccccggggactcgacggcgcatccttgaggggctcctcgtagatggggtgccgtgacccacgaggcagaggctgcagcacagcccatgagggtgggccctgccctggcctgtgtcaggcaccttgtcagcttcccaaagactcagtttcctcatctgtaaagtgacgctgatccgtgcacacgcctggcagggtgggcgtggggctgactgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggcgcacagctggagtgccagctactcggaggcagaggtcgcagtgagccgagattgcacctgggtggcgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtgccagctacttggaggcagaggtcgcagtgagccgagattgcacctgggtggtgcacagctggagtcccagctacgcggaggcagaggtcgcagtgagccgagattgcacctgggtggtgcaacgctggagtgccagctactcggaggcagaggtcgcagtgagccgagattgcacctgggtggtgcacagctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtgccagctacttggaggcagaggtcgcagtgagccgagattgcacctgggtggtgcacagctggagtcccagctacgcggaggcagaggtcgcagtgagccgagattgcacctgggtggtgcaacgctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtcccagctacgcagaggcagaggtcgcagtgagccgagattgcacctgggtggtgcacagctggagtgccagctacgcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtcccagctacgtggaggcagaggtcgcagtgagccgagattgcacctgggtggtgcacagctggagtcccagctacgcggaggcagaggttgcagtgagccgagactgcaccactgcacccagcccaggtgatggaaccagaccctatctcaaaaaataaattttaaaaaaagtttttaaacttttaaaaaataaaaatgaacaaactcggcggctcagcctagtcgcagtgacctagagggagagaagcaggaaggaaaggacacagcccctgatgctttctccagggcctccctcccatgctgacggccctgagtgcccgcgcccgcagatcccaggtttaggtgcagggagtgagcggaggccaggatctcaggaaggcccggggtggagatgagccttggggtcgcttgaacacccaccgcgctccacgttgcatggggcgccgtgggccacacagacggtcaactcctcctctttcccaggctcctggcccagctgaacgaaaccgaggctgccttcgatgagttctgggcaaagcatcagcagaaactggagcagtgtctgcagctccggcactttgagcagggcttccgggaggtgagtggccctgggtggagccggcagccgccctgatgctcacggggcctcctgtgcctgcgccctggtcccagtgccgggagctgagccgtgccacccagttgactttggcttaatgcagaaaagtctccgcttgccaggtggagcctgtgagattaagtcaggctgagccttgaaatgcacgattgatgactgcgtcattgtatagaaaggtgattgaaaatcagctcactgggatgcacttacactgcattattcgtaaagtagcaggaagcctttgctctcccttcatagtcatttgcatgcccttttattcaacatgcatgtaggatgtgcctgctgtgtgccagactgtaggacggcgtcacagtcatgaggtgcacagcgacacggccagtgcagccagacccagacgtctccctcctgcggcccttcgtggactcacccatgtccctcctcagcccccggcaaccactcatctgtttccgtggctgtgcttttgccatttcaagaatgtgacattaatgaatcccacagaatgtcactctcgggatttgtttgtttgctcagcacagctctctgcagacccccaggtgccggtggctcactcattgtgttccccggtgtggacggaccacagttctttcaatcattcacctgttgaagggtatctgggttgtttccggatttgagtattacagataaagctgttacaaacattgatatactgatgttggtgtaaatgtaagttttcatttcttgggcttaagtgcccagaatgtaattgcagggttatatagtagttgcatgtttcgtttaagaaaatgccaaacggttctcagtgtatgagagactagttgcttcccctttccccagcacgtggtggggtagtgattcttcatattatgctcacatcctgatgtgtgtgccatctcacggtggttttctgttgcgtttccccagtgttgatggtgctaaacacctttccacgtgcttatttgccattcgcatatcctctttggtaaaatgtcttatttctgttgcccattttctaactggattgtttggttttgtgcttttgttttacggttttgttacattttgagaattccttatatactgcagatactagttctttgccacatatgtggtttgcgaatattttctcctggtctgtaacttgtcttttcatcctctttaacagggtttttcacgtagccaaagcatttaattttgacgaactccaatttgtcaatttctccttttaaggtttatacttttggtcctagattccaagtatattcccctaagcctttttcccctcaaatttcatagttttacattgaagtctatgacctaatttgagctaatttttgtataaggtatgagaattagatcatgatttgttttacctctggatgtccaattgctgtagcactgtttgttgaaaaggccctttcttccactggatttcttctccaccgttgtcaaagctctgggcacatttgtgtgggtctgttctggagactctctattcaattatgtttatctacatacctcttcctctgtctgtaccacaaggtcttaattgctgcaactatataatgtcttgaaatcaagtacactcattcttccctctttgttttctttttcaaaattgtgttagcttctagttcttttgccttttcatggcaattttaaaattatcttgtctacatatatgaaaacaaatttcctggggttttcataggagttgtgttaaacctatattttaaggagaagaaatgtctttactgtgttgactcttctagtcaacaaacatggtattcccaacatttgatttctttcatcagtgtcgagtagttctcagcacacaagttcagtacgtattttgtttgacttacctttaatattccactttaagaagtcatcacagtattatatttttaattttggcatttatgtattcattgctgcacatagaaacacaattgatttttgtatatttatcttgtctcctgcgaccttgctgagcacacgtatttgagatggttttttgtgaagtccttgacattttccatatagaccatcatgtcatgtgcaaataaggacagtttggtttcttcctttttgaagatatgccttttattctaccccccacccacaacaccctgccccactgcgtactgccccaactagagcttccaccatatgataagagtggcgagactggacatctctgctttgtccccaaccttaggaggaaagtgtttagtttttcactgtcaggtgtaatgttagttgtaggattcttgtagatgctcaataaaactatctgggcctagagatttctttgggagacttttaaaattatgaattcagtgtccttaatagttacgcaactattgaaactatctgtttcacaatgagatatagtagtgtgcttttcaaggcaatgtgtagggttgtttatagtattctttcttatctttttgacgtctgcagggtctgtagtgatattccctgtttcatttctgatatttgtaatttgcatcttttccttttttctttgtcaatctagattgagatgtatcactcctcatctttccaaagaactcgttctttgtttcattagttttctctgttgttttctgttctcagtttcattgatttctgatcctacctttattatttctacaaattgctttggtgggaacttacattctttatttgagactgttcctcttttctaacatacatatttaataagaacactataaatttccctctcatcactgatttagctgtgttccacaaattttgatgtattgtattttctttttcatttactccagctttttttttttttttttccaatttcccttggaacttcctctttgacccatccattctttaaatgtatgttgtttggcttccagtgttcagagattttcccgttgtctttccattcttgatttcaagtttgattcattgtaatcagagaacatactctgtatgatttctgttcttataaatgtgttgagatttgttttgcagcccaagaatatggtctttcttggtatatgttcctcacttgaaaagaatgtgtattctgctattgttaggtgaagttttatacatatcagttagatcctgttggttgatggtattgagttcttctatatccgagctagtttctgagaggtggtgcattatccataactcagtggctgtgcgtaacatggagagaagtctcactcatcagctgtgccagatgcagggggttcaaggatggacaagaatcctgccttcctggccttcaaccccaggccatctgaactacaacccccttggcactgggatgtctgcgtacacacccattctcaggatcatttccaataacaaaaattaaaagcttttgtatttaaaggaataagtggtcatatgttttaaaaatcaggccaggcatggtggctcacacctgtaatcccagcactgtgggaggccaagacgggtggatcacctgtggtcaggagttcaagaccaacctggccaacatggtgaaaccccatctctactaaaaatgcaaaaattagctgggcgtgatggctggtgcctgtaatcccagctacttgggaggctgaggcaggaaaatcacttgaaccagagaggcagaggttacagtgagccaagatcacgccactgcactccagcctgggcaacaagaacaaaactccgtctcaaaaaaaaaaaattaaaaattaaaataaaaatcatttctatgacacccattgtcttcctgccaacagcagaaatcgtagacattagaagttagtagcaagctagaagggactgagttacataactctccacacctaggatccagtaggaatgctgacaattccagtgtccatattgctgctggctttcggctcccagggcctttgtccttgcgtgatctcatcttctcctcatgctgttttcaggcgtgtggttgataaacggaggcacacacaagccacagagaaacaattgttctgccagtgaggtcactggtgggtagcgtcgacccagaggccccacggtccccgcttgattggtgaccactcggggccgactttgcacctgtctgactgtggtccctgcttgattgatgaccacttggcccgactttgaattctgtcatttccctgatctggagcactggagtgggttctctctgttcaggtgagggagacacccccctgagatgggccctcctctgttccaggtcaaagccatcttggacgcagcgtcccagaagatagcaaccttcacagacatcggcaacagcctggcgcatgtggagcacctgctgagggacctggccagcttcgaggagaaatcaggcgtaaggcggggtcccggcgggggcggcgggagagtgtgggcagcatcatcaagtgctgctcaggaaggcgcaggaatgggcctcccgcctacggagaacggaccccacagccccccggggatgtccatggggtggggggtgctgctgcctgtacccctcccctcccacaccccacccacagcacatggccctgcccggcctcctctgggtcaggtccctgcagacggtcaatgcctttgctgggaccaccacagcccccagaagcacttgccacagaacagcttcggggattaagcagcatctcaggcatccgcagcagtaaacaaagaaatcaagacacacgtgtgccccgggacacacatcccgtacagcaaggcactgtgtgcctcgaacagaaagaggcctgagctggtcctctgggtggccgtccacaggtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacggtaggccgagccggaccccaccccactcccccccagctgcggaaccagcctcttcctcccacatccaccaccggctgacccttgtcgtggggagggcagctctttggctggaaaatgtccttgcacccttcgtttctggtcttgttggcctagagggtctttttctagaattcatttgccacagttttatttctttttttttttttttctcactgcaacctctggttcctgggctcaagggatcctcccacctcagcccccaagtagctgggactgtaggtgcatgccaccgtacccagctaattcttgtattttgtgtgtgtgtgatagagatggggtctcactatgttgcccaggctggtctcgaactcctgggctcaggtgatcctctcaccttcacctctcagagtgctgggattacaggcgtgagccaccctgcccagccaataatgatttctttaaaagatccagaagcttaaggcctggttgatcctactgcacttaccctgcctctccaggccccgccctgggtaattcactggtgttgtccagcactgtgtccccttgggattggccttgtccagcactgtgtccccttgggattggccttgtccagcactgtgtccccttggggtgctttggacagggtggcgggagcacgaggagtcggtggcccgggatctgtcgggaggacaccccggcagtgtgtgcctggacagggtgacgctctcaccctctcacggcgtcctgccctcggcaatgctctgtgtttccagtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggtaacgctgactcgggctctccatttgcagcttgctgtcccgagcagtgaggcattcctctgtgggaagtttgaaagaatcatttaatgaattatttgtatttatttattattattttttttttgagatggaatctcgctcttgtcgcccaggctggagtgcagtggcacgatcttagctcactgcaatctccgcctcccaggttcaagcaattctcctgcctcagcctcctgagtagctgggattacaggcgcccaccaccaagcctggctaatttttgtatttttattagagacaggttttcaccatgttggccaggctggtctcgaactcctgacctcaggtgatccacccagctcaacctcccaaagtgctggaatgacaggtgtgagccaccgcacctggcccatttaatgaattactaccaaataataggcatatgagagaaacacacagttgggaggtcaagctgaattttcctttcaacacagaaattatttccacgccaaccctgcgaggtggccatcccgcctccgctggcagactttgtggcatgggtgtgttcttcaggaagggcctggccctgggacctggtgatgcccttgagaccaggctcctcctgagccctccacatgcctggggaaggctgcaggcccctccctcgcatggagctgccctttcccgaggccggggccccgtcccgtgtgggggctgcatccccctctccgtccgtagtggccagggctggacacagctgcgctgcgctgacagaccccgcatggagaacatttaaagcgggggttgggcgtgccccggcacgttctgcgcctgactgtgtatttttagtgatgacaccaacatgtgcaaggcaccttactgagcatgcggtttcaggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggtctgtgtggccgcccggtgccccgggtgctgtgggaccctcgggggagccccgggcgttgagagcttggtacatctgaggcagccacctgcgaaaactgtctccacacgcctcctccccttccacctccgggccccagttcagggcctgagggccggttcccgccacccctcacccatgtttataaatggagttttgtcaggacccggccacgcccatcctgtgccacgcacatcttgtaggcatcgttgtggctgcttttccatgaggctggcagggttcagtggtctcagtgaagcccacgtggcccaaaactggaaacacagagctcccacagaggaaccatctccggccttcccagctccagcctctccacggtctgtcctttcccggtgctattgccaaacaacattcctcacacacggcccagaccctgggctccaggagccctgaagagccacgtccgcgcacctcagtccggcgcgcattgctggtcccaaacccgccctctatgccgagccaggcacggcgccatttcccagagactttcccgccacctctgtgtctcaaaacgaaccctcttcccatccttgctggtttctcacacacgaacccaccaggcgagctgctgccccagctttggcgaaagtcagctgtcaatctcaggggccccgggggccaggctcttgccttcctgtgctgggtcccaggcgaccttattttctgcctgttgggagctctcccaggtcggagcccacaggcgctgtgtccccgtgggctgtgggaacgtggggtgactcagggcagtgaggccccaccgtcctcccccttcccgcaccaccacctgtggcctcaaaggccaagtcctgcccacgccaccacctgtggcctcagaggccaagtcctgcccacgccaccacctgtggcctcagaggccaagtcctgcccacgccaccacctgtggccccagaggccaagtcctgcccatgccaccccctgtggcctcagaggccaagtcctgcccacgccaccacctgtggcctcagaggccgagtcctaccctctcctcggggccttttcccgctgggtgcacttcccctctccagagggtcagaggggacttcatgccccgctccccttcttcccaacaggcattcggcgaggctctgagaactccagctccgagggcggtgcgctccggagagggccctaccggagggccaaggtgaggcttgcccaagacaaccccgccatccacacccccctccttggttcacgctgggcctggttctccgtgtggccccccctcccgggcactgcccagctacctggccagctccccatcgtgggaattcagccctgtccccatacgggaactggtgggctctggccttgagagttggcccttgaggttccgtcccgcctttcagacctgacgctgtttttctccccagagtgagatgagtgagagccggcagggccgcggctcagcgggggaggaggaggaaagcctggccatcctgcgcaggtgggtgcgctgcccttctgtcctcacaggggccctccgaccgcagcctgaaccaccagatgccgtcaggcactcgagcagatgcctcacagatagaaggctggtgcagaagtcattgtggttcttacttttgcaccaaccgatacccagagggcctgccgtggctcgagcgtgtgtcctggtccccaccgcgtgaagcacacacacgccgcacacacaccactcgggattcaggagggaagagagggcgatggctgaatgcaacagtgaaggggcatcttcgccccagcaagagcctccacccgccactgccattcacaggagacaccactcaaaggccccaaccagcaccagctgcagcagcagtcaccagctgctcagggctcagtgtggcaggcagtggtgccaggcagctggtgtgtgggagggcatcgtctccagccctccttttcccctgggattcctggaccctcaaactcagggagtgttgtgcaaacaaaagcagttctctttcctccttcacctttaagaaagaaagacctcactggtgcagggccagggaatgcaggtccccagagcaaaactgggaaggagccaaacacccatgaggcacacgcggctccctcccagaggccctcgaggaagaggaggaggccacacaccgaccaggcacccgccactggcttcacactttgcactgtctccgtttttagtatttgcactgaatatgtttgcaagagacgcttggaaccacgtctccccctttcaccatcaaaactccaaaatcaggaaagaagaaaaggctcttcctgatgtgttgacaagcaggtgtccgcaggcagcgccagtgtgaccctgcagggttgggagacggcgcaaaattgggaattacaggaaactgagcttggtgtgaaagctgagtctgtcacttccggcttctgatggaagctggtgaaacaggatgggaaggaagaggggcttgccaagaagcgtccaggcagaggattgtccacacggaggagggtccaagcagaggggcgtctgcacggaggagggtccaggcagaggaatgtctgaatggaggagggtccaggcagaggagagtccatacggaagagggtccaggcagaggggcatccgcacagaggagggtccaggcaggggagtgttcgtatggaggagagtccaggcagaggagtgtccataccgaggagagtccaggcagaggaacgtctgaatggaggagggtccaggcagaggagagtccatacggaagagggtccaggcaggggggcatccgcacagaggagggtccaggcaggagagtgttcgtatggaggagagtccaggcagaggagtgtccataccgaggagagtccaggcagaggaacgtctgaatggaggagggtccaggcagaggagagtccatacggaagagggtccaggcaggggggcatccgcacagaggagggtccaggcaggagagtgttcgtatggaggagggtccaggcagaggagtgtctgtacggaggagggtccaggcagaggagtgtccatacggaggagggtctaggcagaggggcgtccgcagggaggagcagcaagtgctcggccctgagacgcagaaggagtggccctcggctggcagttcctgggttgtgagagggagtccagagccctcttgctccccagtcctctcccctgtgccgagtccggggcctctgcgggccgacagctgtcttagaacaagcttgctgaacaacctcaacccaggaccagccccctggctccagtttctgtgcatcacataagcaggcagggccgtaggctgctgaaaggtgctcacacccacagcaagacctgcgcagccagcttgtgcaccctccccttctggatccagtgtggtgggtgcagggtcactccccggaccaccactgcccacctgctgtgtgtgagggcgtgggcagggggcagctccggcgatgccagacccccgccctggccacgaggggccacacagatacccaccacgaggaaggctcagggaggccgggcagcaggcgggcgtcttcttggcagaagagactcgggtggattctagggatgggtcctaggagtaggatgacttgcccatgagcgtgaggaactcagctcattttgcacaggtgggacccaaaagcccaggaggcgagtctgggaatccctcctaccaggcggtgtgtgccgggccaggggcaagacactgccggccagtctgggaaccagggaggcttcagccgccgtctgcagggtctgaggccgcgagctgggaggggaaccccgaggagcgtccagcctgtgggctttgggtcgccgccagtcccctcctgctgggcaggccatcattctaggtggcacctgtgagactgtggagcagaccattcctgctctcccagtgctaaccttttttgctctccacatgacctgccaccaggcacgtgatgagcgagctcctggacacagaacgggcctacgtggaggagctgctgtgcgtcctggaggtgaggctggactcggggagggccgactgccacggggactcccctgggccagctggtggggcttcctctgacaactgctgctcggagcagcctgctgtccaccaaatgcatgtgagagagcgcccacagcagcctggtcgggccccagacggggagcccctgggggcctatcaacaagacacagaccaggcagctcaggggggtccgtacaggggacaagtgtagtgataagaaagaggagctgacacacaacagatgcacaaaccacacacacatcgtcaccaacacaggccacagggtgcctgcgattcccggcacggggcactccagggcaagcaaaactcgtcggaggtgggaggcagattagaggtgaccttggcagtgggctgttgcctgggtgagcttgatgtgagtggtggtcacctgagtatagacaggcatctcattcacccagtgtgcacaggtagtgatcacctgagtgtagacagcgagtgtgcacaggtggtggtcacttgagtgtagacgggtgtccgaatcaccgagtgttcagaggtggtggtcacccaagtgtagacgggtgtctgattcaccgagtgtgcacaggtggtggtcaactgagtgttgacaggtgtctgattcactgagtgtgcacatgtggtcacctgagtgtagacagcgagtgtgcacatgtgatcacctgagtgtagacagcgagtgtgcacaggtggtgaccacctgagtgtagacagcgagtgtgcacaggtggtggtcacccaaatgtagacgggtgtctgagtcaccgagtgtgcacaggtggtggtcacctgagtgtagtcgagtgtctgatttactgagtgtgagcaggtcacccgagtgtagacataagatttgtgccctctgtttcagttacacctgaatcataaaaggttaaaagggagaagggtagaacctccaccccattcccccaaattggtgctgttcataatgcttttgctttgatggatgcctgtcccggtaacttagaaatcacccgagaataaagatgaagggctggcctggcccacagatgagccggcatccctggcccacctgcccccccacagcatcaggcccaggacccccgccgacctctgcgctctccctgcagggctacgccgcggagatggataacccactgatggctcacctcctgtcaacaggccttcacaacaagaaggatgttttgtttggaaacatggaggaaatctatcacttccacaacaggtgggcccttccccccgacacaggcacgcacccgtgatctcttgcagctaatggtgctggcttcagggggctggaatgggggtggaggccaggccatgcctggctagggaggggcgcccaaggggtggactcacagaggcacaggcttgagtgtgggtacatggggccatctctgagcgcccacgtggcaccgtacctggtggcctgtgtctaggcagccaagttgtaagtgagccgccagccgtgaggagagggctctgagcccgagtgcgccctgttttgtggtgcaggaaatgggacccgcctgcccctcatcccctcctcatcctgctgggcaggtggaagccggaaccccctcccaggtgtgtattcggccctttagggggtcaccgaaggccataccacatagcaaggcctgttttgttcccaagctcttgaaaaggacggcaaactaggcgttccttacccatcatgggggctgcttgtcccccgagcgacccgtggcctctccagtgcaggtggcctgtccggcctcttgtcctccactcctctgagctgtttggctgctttaacacagttttggggagctcatgggaaggtgtagggtgcacacgcagtgcagaatgccagggaggctgcagtggacagcccccgctgcgtgtcctggaaggaacccatgtgagtggctcccatgcggccatgtgcttggggaccagcgtgccccactggccatgggaatcgccagtgcttgggatgttgttctgacacctgtttcttgccctctcatcacctcacctgccacttacaaggaggcagcaggtctgcagttgaccaccaaggagccttccacgtccacggagcttgggcagaaccttagtgtcccttagtatctgtcctcatggcccccagggtctcagccagtcctgcacgcaggggtccccacagctttcagctgttgtgctcatgccccaaatccatcccccagacggttttcccctccagccggacttcctccaggggacagatgcaacagaaaacagcccaggagcctgggggcggcgctgcctagggccagggctcagggtgtgtctgcagagaacccacagacccacggccagttatgggggtggcgcctccagggccctgaaaggtcccatctctgtctttgcctgcggccctgtgagccgtgtgtgtgctgagggaaaagcagctccctccaacttctgtgtgcagccaaggccagaaatataaagagactcagcctggggctgcacctgctggcgcctgagagcttggtgctcaggacaggcgtggctgcggcgtctccaagtcatgcggggcagattgcccagagcaaggcgtaacaggcttctgaaaaatgacgtccatccacttgtcactggtccacgtgactcggcctgtctttcatactacttaaaaaccttctttgtctaggatattcctcagggagctggaaaactacactgactgcccagaactggttggaagatgctttctggagagggtaggtggtgttttgacgtgtattttgtcacaacttcttaaaagtactgaataatgacttcagattctactgcaagttcctattctaaccaactgaaatcacaaaatacgatgttttcaatttggctgagataccatgatgctcctgtacccctagaacctcctgaacccccagaacctcctgaaccccagaaaacctcctgaaccccagaaaacgtcctgaacccccagaacctcctgtaccccaggacctcctgtaccccagaacctcctgaaccccagaaccttctgtacccccagaacctcctttgcccccagaacttcctgtcccttagaaacttctgagccctgtgccttaaaaccttctgtgcccctagaaccatctgtgccctagaggcacccaggagcaattgcacttcacaatggggctagggtctgttttttgctaaataacaggtaatttgtaaaactgccagagaaaatgctagaagttctattatataaacaaatcaacaaaccacaccataaatggccttctaagaatggctgcggtggaaccccgtctccactccacgcctgtgctctgggaagtcaggggctctgggacagggagccccattaatggagggcaggccccccagcggagcctgggagccagtgccggccctcggaagctatggggccagcagcaatgcctcgcagggccgggaagacgctgcgtgatgcggtgcccgtccctcaccgcgtaatgcggtgcccgtccctcaccgcgtgatgcgctgcccatccctcactgcgtgatgcggtgcctgtccctcggtgcagatggaagatttccagatctatgagaagtactgtcagaacaagccccgctctgagagcctgtggagacagtgctccgactgcccgtttttccaggtttgtccccggaccttcctttagaacgttactccctttcctagccgactcctgaggaataatgaaaattgtgcaaaccaaaggctctgggttggttccaggaatgccagagaaagctggaccacaagctgagcctggactcctacctgctgaagccagtgcagaggatcaccaagtaccagctgctgctcaaggtgggctccgcggtgaccgtggcccggcctccccagcacctgctggccaggtgtctgtgccgccctggggccccgtccccatcgcgccctgcccctcccaggccaagggcacctcttccgagcctgtgctgaggctgggatgcctttcgaggtcctactgtgcgccactgttaggggtctgaggacgcaggtgagcagacgagtccccgtccccatgggttggcacacagcccagcccacatgggattctgtgtgatgtgctgacccgtccctccagggtggagccgtgcccggattatctggcacacagcagggacgtggggcggcctagactggggattccagctatgagtttgccatgtgggtccctctaaccttcaggcaggaaactgcaactccatgcctttggccagggttagggtggcgagaggaaactccccagggagcaggtgcgaggggtttgcacctggcatcagggtggcaggagggagctccccggggagcaggtgcgaggggtttgcacctggcatcagggtggcaggagggagctccccggggagcaggtgcgaggggtttgcacctggcatcagggtggcaggagggagctccccggggagcaggtgcgaggggtttgcacctggcatccgggtggcaggagggagctccccggggagcaggtgcgaggggtttgcacctggcatccgggtggcaggagggagctccccggggagcaggtgccaagggtctgcacctggcaggggtgctgccccatctgcagcaccactcagtctgtcccagctgcaggagggcaggcagggcagctccccacagaccaggggagggtgagcagcatccctacctcgtgccaagctcctgaggggtctgttccaggggagccagggctctccgtgtcccgacgcggttgcctcaccccatgcccctcaggaaatgctgaaatacagcaggaactgcgagggggctgaggacctgcaggaggcgctgagctccatcctgggcatcctgaaggccgtgaacgactccatgcacctcatcgctatcaccggctatgacgtaaggcgcccagatgcccggtcttccccgccgcctccgtggaatacaccagcccagcaacttggcggcctccctgcacacgcccctcgctttggtgtgaatgtgcaggttctgggcaggaggtctggggtggtccctagataagcccactcccaggccccacagccgggtccacagaccccacagccgggtccacagaccccactgggctctctgggacgtggagaaaatcaggaagcgtcccttgcttggagggcacgcatctccagcaggaacgcagctcagacctcctcactccttgtcttctcctggggaggaggcgtggctcggagcagacgtgacttctgttttctgggctgcgatttgcaggctggtgacttagagcaagtggccccagaaggcagatgtcactttccccgtagagccccacatcaggtcacagcttattcatcttttgtccgtctttatgtccacccagcactcattctcaggtgttttttttttaactaatagagttgatttattgcagcaatttttggtttgtgagataattgagtataaatcagaggccctgaggcttcccctagtgttgacatttagcatgggtgccacacctgccacacatggtgaactagcgctgatgctgattagtgactgagggccgttccccttggagctcactctgggtgctgtgcattctgcggtttggacaggcgtgtaacatcctacacccagcgctagagcatcacacagagcagcttcactgtcctagaagcccatgtgccccgccagtccatccctcctcccccagcccctggcacctgctgacctgtcagtctccacgagcttgcctttcctgggacgccctgcagctggaatcccaccgtgggtgggctttgcagagtggctgctttcactcagcgatgcgcgtccatggccccaggcccatcccgtcctgaacacagccctgctgtcgcacatttaggggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacgtaagtgaggccgggtctgcagcagcacgctcctggccacagaccccgacgggggaagtctgtaactcggtctgaggtggccacgctgacacccagctctcagccttaggtgtaggggtggggtattctgccattcttagccctcacccccaaagtatttccatcatttcgtgcctgcaccaacaccttttaaaaacaaggcagtgggttcactgtgcacgcgaaccccatctccactctctgctcgcagatggctgccgttggcattacggagaacgtgaagggagatgctaagaagttcgagatctggtacaacgcgcgcgaggaggtctacatcgtccaggtgggccacccaccctacccctggcctcttacacattgccacgaatggtttctcatgggaaccagtgcaaggatctgccatgaagttgcatcgagcccaggagcagccgctgtacacttcaggatgctgccctgggctgtcttcaccctgagctggacccagaatgaaatgtggggaaaagtacacatcagacggggtgctgcgaggaaacgggctctccctccccaggggagctcatgtgtccctggacggtgcaagtgtgcatctggcacgcagggccgattctcacggtggggagggtgccgtgccctgggtgccaggcacagttcttcagtcagtcccgtgcatggggcacagagggtcccgcaatgcggggccacccacagtgctttcctcctctcccctcacacgcagccacctgacctttgactcctaagattatctttggatgttccgagagtgaaaccaaagcgtgtttcctcgggggcctgagtactcacctcctggcgtttcttttggggaaacaggcgccaactcctgagattaaagccgcgtgggtgaatgaaattcggaaagtgctgaccagccagctgcaggcttgtagaggtgaggctgtcttcaagcgatcgtttcccgtagcttccgctccaggtgcatttttacctatgttcagagcaaccgcacagtccccccatgcgcaaggtgcctcggcgttgaagtaaagacgctcgttcacgtggtttgtctgctccctcctcgcagaagccagccagcaccgggcgctggagcagtcacagagcctgcccctgccggccccgaccagcaccaggtgagaatggacacgctgccgcaggcctgcgtttctggagcagtcccgagcaggccatttgcacgccagggtcctcggcctctgtcagtgggaccctgtggttattggggttttccttgaggcccctggtgtttatgtgctgacgggtccgtcccagagggtgtacttcacagatgtgtgcctccgacaatgcccagtccctctccagctcttcccggggtgggctgttccacagcacggcagtgcgcacatggcctgtccagatcacagccacgccccagcactcctcagacagtcggggctcagctgggagccggcactgatggcccagcacacacgtgggcacgtttcagactccgaccctgaccgtggcttcgtcgtgtctcttctgcccttgttttttctttattttgttcatccacttatttttttcactttatcctgtttcttatataagctacctttaatcattcatggaacaggatatggcctaaataaataatccgtagaacagtagttttaaaaaagaaacactcccccgcccccccccccgccccccgaaaaaaaaagcctcatacttcagagcaagtagggtgggcgtctgttctcatccagcccgtccgggtttaacttagaagtgtgtggcccctcagaagcaggagggtgggcatctgctctcatccagcccgtctgggtttaacttagaagtgtgtggcccctcagaagcaggagggtgggcgtctgctctcatccagcccgtccgggtttaacttagaagtgtgtggcccctcagaagcaggagggtgggcgtctgctctcatccagtccgtccgggtttaacttagaaacacgtgcaggagatgctgctttaggatcaggccgggagctcagagatatctgaatgcctcaggtcctcagggcgttctgaaagactaaccaggcaacacactatttcctttttgatttgtctgatgtcatcagtccctcaagaggaaactcaaggaacatcaagaagctggaagaaaggaaaacagaccccctaagcctggagggatacgtcagctcagcgccactgacaaagccccccgaaaagggcaaaggtgggtatgtgcagggaccgggcctcacacggaggcctcacacggagctgctcacggagtgctcactgcatccgagaaacctgcgcttcctgcagtgtgaagaagctttgcagagcattcagggccccttgctcccctcttaacagagccctaggaccccacagaagagcccctccctctccattgctctgcacccctgcatcagcaaggccagccccagaaggagcctcggccgagcgtgcaacccggagccgccttgggccctccctgcgacagccggacccgcctccgcatcgggttgcgatgccctctgcatagtttctttctcttccttcatagatgacacggtcactagctctgcctcagaaagctctgcgctttccagaaagcgctttaccctgcagggttttgctaacctcaaaggtcagaaaggtaaaagtagtgcctgccccaaacccaccctcaccgtggtggcgtctgtcatgcatcgtgtgtgaccattcgtgcctccttcgtcacaagggcggccacgcaaaagcgtttctttccacccaatcacgtgttccctgatgctgtgtctcgcgcacagacaccagagttatttagaggtggctttccttcgggaaaatgaaggcgagcttttcaaatggaggcttgctcagaaacggagctgtccttggctttccaggccccctccttcctctccctgccccccacccccgccttctcccgccttctcaggtgagttccctgcagggtgctgaccttgctggctgcgtgtctctgctccgcctggtggcagaggccgctcagccatcttctggggcatccactagtgaacagggctgatgggacccttgagacggagacgtctaatgccctgctcacctgcgagagctccatgatgggaaatacatggcggggaaatgggcccaggaggccctggaagccggccctggcgtgcaggcggctcttctgggaagccctgaaggccagcgtggacaagggctctttccagagaagtaggagtgttttccaatttataaaatgcttttaagttggcctgagacttgaaacaaacaaacaaacaacagattctggtgctgcaaactctgctagcgcagaactaagaaaacgtccctagagacgggccccgaaaggacgcctctgagtgccgcagcccccactcccatgccctcccggcccctccttcactgcgcggcccctcggctccctgtgttttgctcacagaagctcctttttcatcggtggaaaggggccacaacgtcggtgtccccttccagcacgagcgcgggtcagcctcctcgccgcctccctccgtccttcacactctctctccggttgtatttctgcctcctcctcctcttgcagcttctcctaccagtcctgacaaaaaagccaagcggcatgaagtaaagagcgacccgactccctttggtgtgcgaggtagagtggcaccctcgggcacggcacccactctgcgttggcaggaagcgcggcccagctggctgtcaggtggccgtcaaggccacctaagggggatgctctcgtgggtctttatgctgcggaggcagacacgcggttgtgttcaatgtgtgatgctctggtgacaggtcctcgaggacagcacgcctctcagccaactcctcacagcaggtctatctggagcctgcggaactgcccaccccgtcggtggctgctggccacggctgctgcgctggtcacctggccgtgctgggtggagctgggtggggtctcactgcccagtggctgctgtcggctatagggcaccctgttccctgcccttccctgtggcacagtttgccccgacacttcctgctgggaacacagagcatagcaactggcagggccgacccggaccctcctttcccggggccaatgaggccgagctccctgtccgacccggaccctcctttcccgggccgacgaggctgagctccctgtggaacctggcccttctcgtttcctgcctcccttatattctcagggtgaaaactgccctgtgaagcccagagacctcccctggcctgttgaggaccttcaagtgcagggacggggctcatgtttgcaatcttgagttttcaaaaatttgcaaaggttcccaggggtgtaagcagaaccagccttcccattccgcccgcctccacagcctcctcacatgacacagcgagcctcacagaaccaggcagaagctgtggccaccctgggcatgagttcagaggcagggagctggcccggcgttactgactgtcctgcctgcaagtgggtgggcgcccggcttgctgcttcgaggccccaggagtgcttgggagaagggagtcatttccctgttgacagtctcctgggagaggctattcttgtctgtcaaaccctctccgcttgtgaactggagtcggcagagccggtccctggtggagaaggtgggccgggtgggccctgtgggccaaatgccgcttctgctgcactttggccaagctcagcctctgcttccgtctcgtcatccatgaatgaagacagtacagccttgcagggtctcgagaaagccagtgtggtgttgaagccgggccactgcccgtgggtcatttccaccgtggtcagtgtggtgtcagagccgggccactgcccgtgggtcatttccaccgtggccagtgtggtgtcgaagccgggccactgcctgtgggtcatttccaccgtggccagtgtggcgtcgaagccgggccactgcccgtgggtcatttctgctgtggttggtggtagtgagcccaggtggttctgggtggcctgagcgctgcccagcacccactccccaagccctgcaggtggtgactccaatgagcaaaggccaatggctgttttacagaaaacagagggcaccttcctggccatcacccggcctcctgccttcacacagaatcccccagctcctggtgcagcagtgctggcctggcctgtggctgcccactcccaggcactgccgttcccatcatggtcagacctctgcgttttgctgttggcctcccccgcgccctgttccagcacagcgctcttgatggcccgcagagaggctctggggagcactgagcacccacggccagggcagctcaagaatccttttgtgtctctggtggtgccaggggcagagtcgcttgggtttcaccccgcacaggccggcctcgctgcccctgtggacaggttcgtgtgtaaggtcctgcccacgccacaccagctcctgtgcacacacagcagcccccctttttttgttcccactgtcctcaatcagacttttggttctgtctggccagaggccccacgtgcggtgcctcagagcgactgggggcctggacggggagggcacgctggcagccaggccccacaggccagtccctgctgctgtagaggaggcacctgggcccccacccttgctgtctctcagcctcccttgctgggggcagctgcaggtgcactcaggaggccaagctgcaggtctgcaaccggaaaatcacagtcctcaattctcacacagatgcaggcctggtgtggtgcctggaaggctcaactgcctccagctgtgaccccaagaaggcaaagcacccgggtggggtggaaggagcagccccgtgctctgctggctgacagtggtgcccaggcccagctcccttctctgcacagacagcagagttccgcttagcacaggcttttccttgccagcgcagacgctgtcagccattggaactggcctgcaagacagcttgctgtggcggctttgcaggcacagggcacacaggcatccgtgcacgcagctcctctgtcctccccatgccccacaccctccatcgcaaggaaacgcttgcttccagtggtaccaaataggatttggaaccagtttgtgcccaagctcaaatctcgttagcatctgcctgtttccctggtgtgcatgtgtcctgcctcgatgcatttggcagcaggtgggatgcgctgggcctgctgcctggttgctggctttgcgtgtttatttagccccaatggcgtctcccatctcccccgcatgggaaaggccggtgctgccctctgggagcctggcaggaggaacactgggttggggaggggggcatgtgtggtcccaagtctggaagaagctccttcctcttctcccgctgggagctgcgtggccgatgggagcccatctccaccgcggcacctgcatggtctcagccttccggttcggtgccgctgtgccgggggctactctcttgccagtggggaccacagccctcggtatcccataggtcaagggcgtcaggccctctcagtgagcttcagtcattcactttagaaactgcttcccggctcggtctgctaggtgttgaacatgaccgtggcactcactgaaaacacctgcctgggagggcatctgcggcaggaaggctgcttccctcctggctgaggggcactgccctgcctgacaagggcgtggcttcccagggcctggggatcgaggtctcccacagggtggcccagcaattggaagcagatggtctcaaaccctgaaacgtgccaggcattctggaagtttgcaggggtgtcctgctcagctctttatgaacccgggaagatgacaggctctgttgggggcccacggcacacatttcagggggtctgtgggacttagctgaccccacctcagacagatgcagacagcggctcatcaccggggggtccctcacgggtgtctgtctctcttaggttggagcaaaacgtcccactcactggaggcacctgaggacgacgggggctggtcaagtgcagaggagcagattaactcgtccgacgcagaggaggacggcgggttgggccccaagaagctggtaaccacggcttccctgtgggcacttggggtgggggctgccctccggggattaggggtgcttctggcaggtccacccaggcttgggtcttaggacacagccccagctcctcctaaccctggaaggtccacatgggcctgggtcttacgggcagtgccagctcctcctaactctctctggaaggtccacccagacctgggtcttggggcacagccccagctcctcctaactctctctggaaggtccacctgggcctgggtcttaggatgcagccccagctcctcctagctcctctgtctcagcagcactttgtgtttctgggttaatttccaggtgcccacccagcctcctgtagagcccactcgtgggtgcaccttcctcagaggagacagtccccacccccctaccctttatgtcatagaatgctgtcactgagccttcctaactatacatacaattctcattttgtaagaaaatggaactgctaagcatggatttgcatttgaaaaaacattcattgttaatgtcagaagcaagaaaaagctgccatgtgttaatcattccagtgagggttacaccaagaagtgtctgctgcaccttctgtgctgtgcgtggtccatgccccaaggctggaggtgcaaaggggacaggtcccggaggctctggaagggcagagaagccaggcgtggaagggtagggagagccctcggggcctctggcctctcccacagagacagcatgaaggaaggcctgggcgtgagaacagatgtgggggacacagaggcggaggccacgtggcaggaggggaaacaggctggtggaacagggtgcacggggcctggggagggatttggatctcattctttgtggggtgtggggagtgatcctggctactctgggcaccacagaggcaggagccagtacaggccatcacgtgagggcaggcagcccagtcaccgtcctcttgctccaggccatcatgtgagagcaggtggcccagtcaccgtcctcctgctccaggccatcacgtgagggcaggtggcccagtcaccgtcctcctgctccaggccctgcagccggcagcacccctccgcagcccaccacacgcagcaccaggaggctgtgaatctccccactctgtaggaacagctgccgcttcctgggtccccattccccaacggaacgtgttccatgacatctgtgcagcatccgctgtgtgccaggcacagttctaggccccggagacaaagcgggaacagcacagacaggaacctccactcttacagtgaggagagaaagaggagtgaggcttggggaggttgggcaggacagctgcagggagagggagggcagaggacgggcgagtcggggagtaccaaggaaggcctcagcaaagcagcatggaaataagacctgaaagcacggaagggccctccgggaggcgggtatgcaggcgcaaaggccctggggccgagagctgtgtgtggagaccagcgtgaggggctggggcagctgggcccaaagacagattcacagacgccttccatcgccgctgcggtagtcatgccctgcggcgtagcctcctcccaaggctggagcccttccccggagctggtcgtggccaggagctcccaccggggcagggcgctaaggcccggcactccgcctggctgctgtggggctgctgccggggcgggtgctgacgctgtctgtgcccctgcccgtctcccaccaggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcagtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgacaaaatagcaacaaggttgtgcgtgtcagaaacgcaaaggcagcagaggaagcgtagtggaaccattacagaatcacaatgcagccgacactctccagaccagaaaagggagcataaagaaagggtattgatccaatagaagaagggaagggtggagaaaggggaaagcatggttaacaggaaacaacatgtaacggaagagacagcccagatgtgtctggctcacaacagacgtgatcatgttatgctggcctggaagagcatcggatcagacgtgacaagtcactgcttagagaccatcaagcaaatttatatatagattggagatttaaaataaaagaagacagaacagacaaacaccataagaaagctggtgtagcagtatcgatgacctgaaatgggattcaggacagttcatagagtaaagggggctgcgtggcaatcaggaactcataagccactgactataaagctcaaaacacagcaaagttggcagtcggcagacagcaatgttgactgtcatgaaaagtgatccctgtttgcccctaaacgtagagaaatctgcgttattttccagcacacatggagcacaaacaaaatatttgcaaaacaatgggaagatcattgaaacactgtttggcaatttaaaagcttgtttctaactcacgggatgcgggcagtctgctctctagaactggacagcgtgcacagagccacgggagggagcagccacggccagctcagattggtgtcgacagcttagtggtgtctgattttatacatgacaaaatgaacgagttaaccatttaagccaaaaaaataagactagcgtaacccaaagaaagtatttaaatacttctgtcaattaggacagttgagaaaagagaataacaaaatcaaaagcaaaactcaaactttgtacctgaaaaatctaataaaactgactaatttatagaaaacctaagaaactccatatcaaataaaaaattttaaatatgagagaaccattatgaacacctttctgccaatatatttgaaaacagataaataggatttattgttagaattggtcaagaagaaatgaaatacttgggttgatgaataacagttacagaaattgcattgcaattaaaaaaaaaattaccccaaacagataccagatctaggtgattttgtaagcatacaaacatatttataaaagctatttaaaagaatataacaagagaaagcaactcaataaagttatgaatcaaatttaaccttggtacccaaacctgacaaagattatgtaagaaaagaatcagctgggccaggtggctcacatctgttcttctagtactttgggaggccgaggtgggagagttgtctgagaccaggagtttgagaccagcctgggcaacattgcaagacaccatctctacatgaaatttaaaaattagccgggcatggtggcacatacctgtagtcccagctacttgggaagctgagaccttacaagtgagcccaggagtccaaggctgcagtgagctatgatgatcatgccactgcactccagcctgggcaacagagcaagaccctgtctctcaaaatcaaccaaacaaaaagacaatgtaagaaaaaataaaattatgaagatgaatgcaaaaattccaaatgaaatataattaagtaaaacccaattctgtgttataaataaaggtaatactttctaagcaagtaaattcatcccaggaatgcaaggggtagtatgttaatgtggctataatttgccatattaatgaagtgaagggtaaaatcaccagcttaacaaatgcaaaacaataattcaatttttattcaacatgtacttgtcatgttaggccaactaggagtagaagaaaatttctttaactaaataatatgtatcaaacaaaatctttgcagcgaactttttttttttgtttgtttgtttgtttgttttctgagacggagtctcgctctgtcgcccaggctggagtgcagtggcgcgatctcggctcactgcaagctccgcctcccgggttcacaccactctcctgcctcagcctcccgaggagctgggactacaggcgcccgccaccacgcccggctcattttttgtatttttagtagagacggggtttcactgcgttagccgggatggtctcgatctcctgacctcgtgatctcccacctcagcctcccaaagtgctgggattacaggcgtgagccaccgcgcccggctgcagcaaaaattttaagtactgaaatcctttagaaccatccccattggcagcagaactgaacggggccccactactctccagcgccatttagccgcagtactagtgactaccaccgcaaaggaaaaggaaacaaggccagcgcggcggctcaggcctgtcatcccagcactttgggaggccgaggcggcagatcacgaggtcaggagatcgagaccatcctggctaacacggtgaaaccccgtctctattaaaaatacaaaattagccgggcgtggtggtgcatgcctgtaatcccagctactcgggaggctgagacgggagaatcgcctgatcccaggaggcagaggttgccgtgagccgagatgtcgccattgcactccagcctgggcaacaagagtgaaactccatctcaaaaaaagaaaaaaagaaaaaggaaccaaggcatgctaattgaaaaataacttttcatatctagaaaaaccaggtgaattcataaactattgaaactaagaagtccacaagatcaacccacaaaaagttattaacattcctagcaataacaatactattttaacagcaacctaaatactaaaataaatgtaacaaaagttttggacaaaattatgaaacatgatagaaggtcataaaagaaggcctaaatgggagatttttatggatgggacaattcagtatcaccaaagtgttaactctcccccaagttaatctgtgtatttcatcaaaattccaacagaattctttgtggaattaggaagttgattgtaataaacatagaagataaaggtctgagtatagccgtggtgattcggggagcagaggcaggaggaggagggctcacctaccaggcatctggatagatcataaacctgtcatcagtcgtgacaagggggagagaggctaaactggtcgagcagaattcagattcccaggcagggatgtgtgcagggacctggcttgtcctggggctggtcaatctttggcacggaatggcctcttcaggaacgggtgttattgggacagctgcctttccatgtggatgatggcataaaagtatagcccccccaaacttaagattaaaacattattatgaggaaacagaatattcttattgcctagggcaaggatagatttcttacaaaagacaagctacactttaagagatggacaaaaagataagatggacaatctgagcacatcccatggtgaatttctctccacgctaagaccccagacaagggtgaaaagcaggaccaaggcccagagaagaaaaattctgctcaaaatcat

SEQ ID NO: 1185 - DNA, 1931 bp, Homo sapiens
acagcattacaacctgcatttacagaattcttcaacttatttaatgccccggtgtataactgggtttggttttacatggcacttcaagtcaaaggcaatttcagtaagttctcatcattagactgtaagcttcttgaggtcttagaagcttacagtctaacgtagcttagagctgtgctgtccaacacagtagctatgagtcacatgtggtgagtacaaattgaggtggactgtaagtgtaaaatacacattggttttgaagatgaagtataaaaaagaataaactacctcattacattttttataccgattacatgttgaaatgataatattttggatacattagctcaaataaaatatatattatcaaaattaatttcacttttttgctttgtttttactttttaatgtagatatgagaaaatttaaaatttcatatgtggtgtgcattatatttccattggaccagtgatgcccaataaaagtttatgtagctgaattataaaaaatgttacttaatgccacatgtggagtaatgatgataatggtgatagctcatatttaataagcactaagtgccagacacagtgttacttgctctatatgcattactcctgcgagtcagacaaatagttatgtaaaggtccagttcaagagagtcatccgggctcaagaaagactggagggagggtatctgtaaaggcttcaaagtctgccacatattaagcacttggtaagtattagctatcaaaggaaataccagatagtaagtctactgtttaattaacttatgatactatactactcctaccgtctactctcgccctccgctgtcagctgggctaactcctattcagccttcaagtctcagcttaaaggtcatttcctcagcaaaatttactttcaggaccccttcatacgacccccttattcacgcccatggcatattctactttgcctctcggtaacatctagcaaggtcgtctttatacagaaactcgtgttttgagtactgcttgtggccagcgtacgagcgtagcttcccagcgcccagtgcagtgcctggctcagtaaatcttcaccgaaccaccccactccactccccagcaaaaccaccccagaacgaaggccacgccaacgcgggtcgtgctccgcgatgacaagagcccgcgccccaccaccagctgcccttcctctccatctctcagggtgagccttctccccggcgggaacactctctcccaacccgggcaccctcagggctgagggatgcccctttcctaggccacctcctacaaggcccctcgcgatcgcctaccttggccactttgggaatccgctgcttcccggccgcggtggaggccgccatgtctgcagcagtcgacctctggacacctgtccccggcacggacgctagaaatcggctctgagagctcaccgaaaccacaaagctttcagaaaacaaacaggatctcggaaccggaagcggaacttgcaggactgacctttgacctctcgcttgagccgtgacggaggcggcaccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcggg

SEQ ID NO: 1186 - DNA, 11241 bp, Homo sapiens
caacagaatcgtatcatgctcacaattgttaaacttgcctttccaattaatagcaattcatctttaacatatcttgctaacctaccaccacatttaataacagacttagtcctttgcttggaggtatcttaattaacttgactaaggaagagtatttttaaatacacaacagaatactgaaggaaaatgacactctctttgaattgaaatcaaaatagtacattacagaaaaagagatgccgatggaaccctgtctagcatacatcttttgttcaggcagttaagctcaaaggtgatgtgcaaaacaggtttttggaccaatctctgactcttccaccttcttccaacaatgagctcgaatggattccacatttcttttgctccagttctacatacagtcaacaatcaacaaaacgacttacaacatgtaagtggcagagcaaatccaagtgttgtttgcttgccttttctatcagccttgtttattcctacttgtctgaaatagctgccaattggatcacgggcacatcatcacgagagtaatcactagtagtgctacttgctattattcattttagtgttgctagtattgatgagcacatcttgggttatctgcagagttgaccatccacaccagtgctcaccttcacttcttcttcgtactggaatctccgtttgctcacaatgatatcttcaataccccgcctatcaccaaacttcttctcaaagatggtataatttttaaagagttcttgggcatcttgttttgaaattctgtccagggcatacttgtaaatcactcgtaccctttcaaactaaatgcagacaggatgattaccttctataacacaatattctcatgccagtcacaactaggagagtaaatataacaaaatattacttataagttagattttgaggcctcataatatccagagtaagatgcttttctccctcttgttgaaggttatctctgtcaggatggaccggtactctgctttgagctccatatttaatactgtctacctaacactgccaactggatgtctactgcacatctcaaacaggtccaaaactgagcttctgtttcctccccactcaaactgggactctccccatcttcccaattttagtaggcaaggcctaacctacagtcacttgctcaagccaaaaccttcaggtgatcctcaattcctcttttttcctcatactccatattcactcttgcaacatgccctaccatttcaatctcttccacacagccatttgcttctccccagcccccagccatcaaactccactgttcacctggcccacttcaaaagtctccccactggtctcccctggttccacttttgccatctaccctcatacattctccatgaattagccagaggctctccttaaaatataaatcatatccaatcactgtcccgcttaaaacctttcaatgcttcccactggcccgaacagaatctgaactccctagcatggtccgtgcaagaccttatataggttgagtatctcttgtctgaagcatttggtatcagaagtgttttggatttgggatgtttccccagtttgggaatatttgcattatacttactggttcagcatccctaatccaaaaacccgaagtctgaaatgttccaatgaacatttccttcgagtgtcatgtcagcactcaacaagtttcacattttgagttttggattttcagactgggaatgctcaaacctgtatttggatggatctcaattctgtattatttgaactccctttttttttaagaaatggggtcctgctctgtcacccaggctagagtgcaatggcacgaacatagctcattgtagtctcaaactcctaggctcaagtgatactcctgcctcagcttcccaagtagctgggactgtaggtgtgcaccactatgcccactcaatttttttttttagagacagggtctcactatgttgcccaggctggtctcaaactcctggcctcaagtgatccttctgcctcatcttctcaatatttgagctattttcataggtacaagggaaaaaaagaactctcttatttgtagggcaatctctgtttccattctaaatgttttctgttctagggctttaagctttttgtttcccatatttattatcggttaagtcctttacttaggatgccaaaagactagttctcagtttacgggcattcagactaaaaggcttaattttcaaacaaagcacaataaaattaagacagttataatacaatctataatcagctcccatctgtagcttagtcacatatatatgctgttctctgtgagaagctgtgtttttgtattttgaaaacatctttccagggatatgtcagtaagaaaaaatggaaatgaactcaccatgcacaaaatgtaatctttgctaagctgttttacagtataatgaagttaggtatacttacctctttctgattttcttcaaacttggcaaaggcaacataaaggtgctcatccatatgttcatctccaaagaattccacagctctctcatacactttccgtgcatgggcaaaataagcatgtttttcttcaaagcgggcatacttgatccagttcttaacatcagggtgcacgaggacaagtgcaagggaattaaggaaatcccaggcaaaacagcatggcttaaaaaaatagtaagtaagtaaacaccaaaaccataccaaagcctggaaactccaaaaattcaaactacaactctaggggaacaaaacacatacaaaagtgtagaattaaacagtggcttctgtgagagcagggccacgcctgttcatctctattttcctccagtgcttagttaagattttagtggtgggtataaactcgagttggaagcaaagaaaaatctcaacccaggttaccaaccatgtgatcttggataagtcactgaacttagacgtctaagtctcagctgtttcatttgtaaacagggaaaaataatgccagcctcactggattactgccagctttaaatgagaaaatgtatgtaaagcccttagcacagtttctagccaaaagaacatggcaccgtaagcggtcaataatggtctggtcattaaatagcaccaattatattaaaatatgaatacttgaactaataattaagaaaaaaacatgctataaaaagaaaactgttaactagagtcaaagcagaaagttttgaattgtcattttaatctatcttccttgaataaatcattaatttccaaagtagtaatatattccaatatggcaaagaagagcatcagttctgaagctgctctactaggttcacattctatttccatcagcacctgtgagaacccagtcaagctacttaatctctcatgcctcagctccctcatctgtaggacagagaagttcctacactgcaaggatgttatgaggattaaacaacaatatctgtaaagtacttagaatactgcctggcacgtagcaagtgctataaaagctttcgtcaaactaataatattaaaattagtagacataattaagatcttaacattgtcacctcaacagagaagagtaaaaaaataaaaagatcttaatactgcataataaagttgactctcattatttctggtagttatgttctatttagtcaatgcgaacacttaattattgagtactgaaccactgctcctaggagaaacgtgtatatatacaatctcacattcatcatcatcttaaatcctaaaaagaactcatcctggcagattctatcttcattattttgtaagaaaagtggttcagaaatgttaagtgactggactgaggctgccccactgacagggattcaaactccccgactggccccagagccacagctccttgcactacatggcactggcccttcctgtctccaagctctaggcatggttatatgaggttaagaccagaaggcaagcctcaccttgttggacttcatgctctgtgcatgtccacaaatgactgtgaaagtgccacaattactgattttgggggttacaaataaattttagcaaatacgtgattttgcaaacatggaatctgcaaatagtgaggaatgactgtacttcagtttctaaaagtgctttcatgtgtatcatttaatcttcgcaacagcccaacaaaggtgtttttattcttgtttttaagaagaggacaccaactctcaaaggagttaaatgactctctggagccacacagctagtaaacagtaaaccttggatgaactccagtaaggtagtaatgaccaacacaaaccttagaaaaacaggactggcaatggcagccaggaccttagtacagttagtcctccagccatgggttccatatctgtggattcaaccaacctgagataaagtattcgtgagaaaaaagtgcttctgtattgaacatgtcgtttttttgcttattattccttaaaatatacagaataacaattatttatataacatttacattgcattaggtataagtaatctagagattatttgaattatatgggaggctatgcataggttacatgcaaatactacatcattttatatgagggacttaagcatcaccgattttggtatccccttgagttcctggaaacaatcccccaggaatatcattttccacaaggaaacattagcttttagcattacaataaaataaacccaaactctcactagaaaagactagttacccagaatacaaattttcattctgaccaatctctttccctacaaaacatagggaagctgataaactggcattcttgactttgagcctgacattaatgactgtgtgtcctgatcatgagacatctctacaggagcagcagcagcatccaggacaatcatggcaccatacagatctcgtccaaaggatatatcgctcataaatggtgcgggcccgatccacctctttgtatctcagctcaaagttgatgtaggagtgccaggcttgctcctcaggctgccactccatccagcgctcaaacacctgccgggcaccggcaacgtttcccaacatttcctccatgtacgtgtacttgtacctgtaacaaaatcacccgaaaatatctgctgtggtttagttcttccattgttgaatgggaagaagattgaagattttacctttcttaaaggttaaatcaaacatgttttgtcatttgtatgtaaatctgaaaaaggatgaaccattggaaaaaaagatttttttttcttaaaagttgcctagttcaacaagaagcttatgaataaaagattgcaatcaaaattttagttttgattacatagctatagaacattacgattatgacttaatagactatgggacataacagcatttatgtctgaagaaaaagtaggatatcaaattaaactatcatcatgtaaataaaataaatacagaagatgtggaactttgctagtctataaaaggctgttttgttagatcagaaacttaccagaactgattaactcgaggcagcgttgttatggcccggtcccagatatttcgagcatggttgacttggcgattcttcatttccatttctgcgtatttcagccagagtgtaatatttcggtagtctacatctaaagcacgctcgtatatggatcgagcccttaagaagcaagatttgcagggcatcaaaaatagagcattcaacacatgtagcagttatttcaaactatctggaatgcactgatgttttattaggtgtctaccatgagccaagttctgggcataaaaaaatgaaaagatataatgctctcaagtaccttacaaagtcttataaaaagacatgcatgcaattataatgcaatgtgatttatgttatagtcaagatctgcacgggaaacagagaggaagaaatgaaaatgtttggtggaaaaggctaagtagtaggtaattgtagaaatgagaacttgaggaacgttccgatttaccaggaaactaagtttggtgaggagggggtgctcattccaggcaaggagaacagtcaagcctcacgataaggagacatgatatattcagggagtggcacatacacaggcacagtgggggaaggaggtatgcggggagaatgcagaaagctagaccacaggaagggccagattgcaatttttattttttttggccattggttttattttttttggccattgtttagctgaaatttgtaaaaatctcaatatatacaaagcaaatgaaattgtgcttctttagctacaactgacaagatctatctctaaagcctcttctgccaccctccccaggactattctaccccagtactcctgaggccctcaagggaaccctagggttccatggaaccaaagttgaaaatttctacccgaggcacaatcttttacctgtgctttaactttttcttcttttctttttggtatctgttaatctatgaatcattatatacaaaactacactctcagtaattttacctttgaatctcctttaggctttcttcccattgtgcgtattttatccagttactaatcacagtcctgttttttcttatattatcttcaaaagtctggaagaaggcaaaaagggtcaagtcaaaagacaaatgactaaaaatgacagcacccttggtctattttaagtcttgtactaaaatggttattcattttgttcatatttaagagaaattacatcctggaatccttgaggaataagaaacccactacagaaggttacagtcaactaactgatactttaaaatggtctatgcttgtccctaataaaaaatgtttttgactattacctttaagtcctctggtaattctcagaatttcatatataacagcattagtgctttaaaacagtcccacattctagagtgaagaggtcaaatcagatcccaaagtcttctcatggtccttttgcagacctcaattccttttcctttctttctttctttctttttttttttttgagacaaagtcttgctctgtcgcccaggctggagtgcagtggcacgatctcggctcactgcagcctctgcctcccgagttgctgtgattctcatgtctcagcctcccgaatagctgggattacaggcacctgccaccacgcctggctaatttttgtattttagtagagatggggtttcaccatgttggctaggctggtctcaaactcctgacctcaggtgatctgcccgcctcggcctcccaaagtgttgggattacaggcgcgagccactgtgcccagccagatctcaattcttaacacagaaggtggtatagacagaagtacacagtgcagccttactaagcataccctccttcttgttgtcagttgttccatctgctaaacttccgctcactttgattcagcatcaaaaattatgcagattcaatttctttacactttaaccagacaactcatggcatattttatatagttcagaaaaatgctgttatctggtaaccagaagtacattattcatgcgtctggaaacacttaacctcatcttgccctacagaatccaaccaatgaggagcttttcaaactgaccgatacagtcttaacaattagtggactgaaagataccacactgactgaccttccttttccttagtttataatcatttaattcttcttcatctgtgatcttctgttgaggtggaggtggaagaagctcaagttctctttctttagcctctcttaagagttgttcagcagttatctgtacctcagccggggctttgtttttcaccttttaagaaagaagacatttctatttttagtagttgctcttcacacaaggcttaagaaacaaacatacattttttaggatatgaactttgttagtattatcacaagatgccctttttgtatgacatgttcccattcctccatgagactgaaaagaaaaaaaaaataccgttttctctcttattcatagtatctactgcaaagccataggtaaaagtctcaagagaaaaaggtggcaaaaataatagcaagttttcccttttagatgagtataataataaactttgaggccgtctaggtaaaattctgaccagaggttttgttttatcaaaatgtgtagcacatcttattaacagcattacaacctgcatttacagaattcttcaacttatttaatgccccggtgtataactgggtttggttttacatggcacttcaagtcaaaggcaatttcagtaagttctcatcattagactgtaagcttcttgaggtcttagaagcttacagtctaacgtagcttagagctgtgctgtccaacacagtagctatgagtcacatgtggtgagtacaaattgaggtggactgtaagtgtaaaatacacattggttttgaagatgaagtataaaaaagaataaactacctcattacattttttataccgattacatgttgaaatgataatattttggatacattagctcaaataaaatatatattatcaaaattaatttcacttttttgctttgtttttactttttaatgtagatatgagaaaatttaaaatttcatatgtggtgtgcattatatttccattggaccagtgatgcccaataaaagtttatgtagctgaattataaaaaatgttacttaatgccacatgtggagtaatgatgataatggtgatagctcatatttaataagcactaagtgccagacacagtgttacttgctctatatgcattactcctgcgagtcagacaaatagttatgtaaaggtccagttcaagagagtcatccgggctcaagaaagactggagggagggtatctgtaaaggcttcaaagtctgccacatattaagcacttggtaagtattagctatcaaaggaaataccagatagtaagtctactgtttaattaacttatgatactatactactcctaccgtctactctcgccctccgctgtcagctgggctaactcctattcagccttcaagtctcagcttaaaggtcatttcctcagcaaaatttactttcaggaccccttcatacgacccccttattcacgcccatggcatattctactttgcctctcggtaacatctagcaaggtcgtctttatacagaaactcgtgttttgagtactgcttgtggccagcgtacgagcgtagcttcccagcgcccagtgcagtgcctggctcagtaaatcttcaccgaaccaccccactccactccccagcaaaaccaccccagaacgaaggccacgccaacgcgggtcgtgctccgcgatgacaagagcccgcgccccaccaccagctgcccttcctctccatctctcagggtgagccttctccccggcgggaacactctctcccaacccgggcaccctcagggctgagggatgcccctttcctaggccacctcctacaaggcccctcgcgatcgcctaccttggccactttgggaatccgctgcttcccggccgcggtggaggccgccatgtctgcagcagtcgacctctggacacctgtccccggcacggacgctagaaatcggctctgagagctcaccgaaaccacaaagctttcagaaaacaaacaggatctcggaaccggaagcggaacttgcaggactgacctttgacctctcgcttgagccgtgacggaggcggcaccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcgggacagttgtgcccaaataattctaaggtgcccaaataattaactctaaggcttggaattaaaaataacagaaggtactttgaagccagatattaggaaaaaatataaatagagtaactggaaaacaactcagtcttgtgataagaaacatgtttaaattctgtgtgtgccttaattactctagttaaattttcttagcctcaatgtcctcaactataaaacaaggctaataacatctgtttcactaggattaaagacaaatgctcagtagatgttagctgttataatacttaacctgccctcaaaaactgaaaagcaaaggttaagagaattttttttaatagacatttttagagaagttttaggttcacaacaaaattaagtggaagacacagagatttcctccctccacagcttcctgctatcaattattgtacctcttccctcctctaacagcctccaactcttaaaaatatcctccaccagagcagtacatttgttacaatcttgaacctacattgacacatcattatcacccaaagttcatagtttatattagggttcactcttggtgtacattctatgaggttggacaaatgtataatgacatgacttggcagctcatttgttaggataatttccacagttgcaaagctcttttggtgtttggggaaaatatatatttatgtatgtagtaatatcacgtctaccaatgcagatattactttcaacaaaagatttatgcagatttctagaactgcagtcagttataaccaacatcaatgtatttgccataactctttattaaccatattatttagatattttatctcacttttcaaaatttaaatagagaagattttatatcactttcataaagccacctaacaaaataaataaatattaaaaagatgtttctttgaagtgattttccttaaatgtgttactgtaaacaattgatttaccaaatgaatcattggtttaatcatctgttgcctttgctcaaaagtacaaacatgctagaatactttgcttctgatcaccatccttctctcttacatttctgttgtctggcaattcagttcatctctgtgtgtgttttttttgtttgtttttttttttttttttttttaggaaaaatgtattatccttcttactttttgccatcaatgcttttgtagatata

SEQ ID NO: 1187 - DNA, 5643 bp, Homo sapiens
atgttgcctactacatacatccaggattaagtctaatgcctttgaatacacaaggttcaccttgatctagtccctgtgcttccctttctctggtagacttctcccatcaccagcttcactctctttgcttttacactgtggaataattcatcatttcaggcctccttgcttttgctctggctgactctccagcttggaatgccttcatccatttcccttacttcacctttgtgttcctgtgcattcatctttcatagtgattgctattctctactgaaatgaattttttcaaaatagcctgcaattgcaataggcagtactttttttctttctttttagctctagcatctatcacagtgcttgtggtcatggggtacatactcagtaaaatatcttttactgaactcaactagatcttgggggaaaaggggtggagtcattcattcattcattcattcattcaacatatgtttattgagaagctataaacataggcacaaggttatgtgctaggtagtgcgattacaaccaagaagataacccagggcctacttttggtctagtgaaagagatggaattagatgggtatggtggtgtgcacctgtagtcccagctacttgggaggctaaggcatgagaatctcttgaggctaggagggagaggttgcagtgagctgtgatggtaacactgtactccagcctgggtgacagaagaagaccctatctaaaaaaaaaaaaaaaaaaaaaaaaaaagtagggcaacataaatacacaattttaatttaggtgggtaaagacaacagtggaccccagggcacagtttagattattttatggatatggataaacagagaaaagggtggtttttttttttttttttaaatctattttagagactgggtctcactgtgttgcccaggctgttttcaaacttctgagctcaagtgatcctcccacatcagcctcttgagtagatggatggcattttaattagatgaaattgtactaggaaaggcatttgcaaaacaaagtaattgccccaaatcactatgaaaccctaagtcaggcataaaactcacgatttctgacccttcttcatggcctattgcctcctattacctttactttttcaagtaaagatattcttctggtaaacacatggtcaaatacagtgtcttgggtaacgaatagtaaagtgagataacatatgtagagaaagcgggtgagaatccgtactccataaaagtattttctttccataggtgtctgctaaactgccatctaagttttccaaaacaaaaaacaaaaacacttgtgtggtgctcaatgatgtatattaagtgaaacctaccaactgacctttatcctttccttcctgtttttttaatattaaagaagagacctcttttcacaaatgattgaggaggctagtaaaatgcagtgaaaagagcaagttctttgggagtcagacagcatcggatccagcccagagcgcagcacgactagtagagtaacttagattaagtccttaaacttccagtgtcctcttttgtaaactgggaataataataataataaataaatagtgaataatatttatgcaaagtacttagcacagtgtctaacacataaaagcttaggagaagttggctattaagcatttctaggaacccgaggactcagggttgttattttagttcttggaatcaaaggaacttgaagcgtagtcattcctaaactaagttaaaccagaactagcgctttcagcaatgatgtaatttgatctcttcgggccaccgtcgctgagcatgcgcaaataaacgtggcgggacgtatgtgtcatggcgctctccatctaaagtctgtgcagcttccggagagtggcgggttgattttctcactttggactggtttttacttcccgacttctgggtaagggtggccgatgggtccatgtggggcagagtgtggccacagctccttttatggccaagccttgtttctccagtttcagtttttcttgggctgtttgcaaatttgtttcgcagttaaaaggggatttgccagctgggatgggggaattgggaggcagatggggcttccaggagcgaggatagggtcgttggcctcaggtgccgctctccagttaggagtattttaggcacctcgttccttattgtcaggtttaacttcatttgttctcccactttataccttagtgaatttgtagatgtgacaaggctttcgcagttatatagctttcccagatcagtatgttaagaatttaagcagaagttattgagaaaagcaggtgtcttgctttttcacttttcgttcttctttgctcataaaacctttttctgaatctcgggacgacagttatctttcggatggaacgtgatctggatgtctatctaccttattgacttaatcctgttttgtagtggttggttactcgcactatgcagacgtgttgcggtgctgaatacaacatttattactaaagccagacactggatcaccgtcacggcagatgtcagcacacctgttgtaatcagtaagaagttacaagtagtatggagcatcattaatcctgctgtataaagcagtcttttatggagtctgattccttttaagtaaagaatccttacagtggttttgtgaactttttgggtgcttacttttcctaatcaatttttattttccagactcatctttcaagaggactttagactaattgcagataattaaggtactgatttattttaaaccttttatgtttgagtgctgtgcgtatttctgcatgttagaaaatgcagagaggtagcctaatgttttagctatttgccactatcatgttatggaaacattgtgctttacatagcattaaatcgaagagatattttcatttattttacttaacctttcattttcattcaccagcattgaccatgtccacttttttgagatgcccttttcatttgccttccatggcccatggatttttttccttgtctggtggctgcttcttggaatccattataagctgattttcctttatctggcagttaaatttggagtctctcaagtcgtggtcttgtaccttctcctacctctgttctctttttcttcccctctgggtgatgtaatccacatgcctgtcaacagttatttgtctttttgattctacccatcctaatgggtatgaagtggtgtattattgtggtttggatttccatttccctgatggctcatgatgttgacatcttttcatgtgcttatcagccatttgtatgtgtgtgtttttgagacacggcttccctatgccacccaggccagagtgcagtggctcgattacggctcactgcagccttgaccacctggtctcaagtgatcccacttcagcctcccaagtagctgggactacaggtgcatgccaccatgcccggctaaattttacttttttttttttttttgtagcgatagggtccgtgttgcctaggctctggccttgtactcctggcctgaagtgatcctgccaccttggcttcccagtgttgggattataggcatgagcctctgcacctggcccatttctgtatcttcttcatctaatctgtttttccttttgttgcttgtgcttttcatttcttagctaagaaagaagggcctactctaacatcataaagatttgtgcttatgtttttttctaagagtttcataatgttagctcctaaatttaggtctatgatccattttcggttaatttttgtatatgatgtgaaatgtgaaatagggctccaactttattttttacatgttgctatccagttatcccagtgtcatttgttgaaaaaaaaactacgctttcccccttgaattgtctaggttatgtatatttgacatacattctaggtggtttttatgaaagaataattctgggacagtgattatcaaactttaattcagatcaaaatcacctagagggcctgttaaatattgctaggttttactcaaaatatctgatttagtatgtctggagtggagttcaagaattttcatttctggctgggcatggtggctcatgcctgtaatcccatactttaggggccaagatgggaggagtttgagaccagcctggacaacaaagcgagaccttgtttttacaaaaaaactgaaaaagaaaaaatgttcatttctaacaagttccccatgatgctactccagctgatgtggaaactacactttgaaaaccactggacattgctttgcaactgtggctgtacacacatgagaatgactggaaagtttttaaaagatattgatgcccaggctccattctcagagattcattcagctatcttggggcttagttgggaattttcttttttttcttttgtttttgtttttgttttgagacagagtctcgctctgtcgcccaggctggagtgcagtggcgtgatctcggctcactgcaagcttagttgggaattttcaaaagctcttcaggtgaatagaatgagtgttgaagattgagaaccattactgtggaatcgtggttcttaattagggatctatagtggaattacctggacagtttctatgttcacatacttcagttctactcttggagattctaattcagaatggaacctggagatttgatatgatgaaaagcttcccgctgggtgcagtggctcacgcctgtaatcccagcactttgggaggccaaggcaggtggatcacctgaggttgggagttcaagaccagcctgaccaacatggtgaaaccccgtctctactaaaaatacaaaattagctgggcgtggtggcaggtgcctgtaatcccagctactcgggaggctgaggcaggagaattgcttgaacccaggaggcacaggttgcagtgagccgagatcgtgccattgcactccagcctgggcagcaagagtgaaactctgtctcataattacaaaaaaaaaaaaaaaaagcctccctaataactcacctatgtaagtaaccactgctctaggatattgcatcctccttcttcctatcattttgagtattttccttttcactgactctatttttattccctttatcaaatttgatttcctctacctttgagaaaaatttttaatgatccttttgctccatttagctattacgctgctttccttttattctcaaactttcatttccatatgatttaattaaaaatttctgaaggctaaacaattccctctatcagtctatcagtttgttcaaagtaaaacctttagcttattaatagtgatgagtgagattatttaggtacttatgatatacagccaggtttatgctacataatgctgatatgcagcgttatatttatcttttttgagtgaatatctccaaatgaaattgctggctcgaaggatatacatatgtttggtataattgtcaggttgccctccagaaggggtgtaccagtttttctgtgctttcagctaacagagtttttgtcagctttgtatcagtgaggcagctgaaaaataacttattgtttcaatacttgttgttagtgtggttgagcattctttcctctttttttttttttcttttctgggtatttgtatttcttaagtgaactgcctgttttt

SEQ ID NO: 1188 - DNA, 9617 bp, Homo sapiens
atgttgcctactacatacatccaggattaagtctaatgcctttgaatacacaaggttcaccttgatctagtccctgtgcttccctttctctggtagacttctcccatcaccagcttcactctctttgcttttacactgtggaataattcatcatttcaggcctccttgcttttgctctggctgactctccagcttggaatgccttcatccatttcccttacttcacctttgtgttcctgtgcattcatctttcatagtgattgctattctctactgaaatgaattttttcaaaatagcctgcaattgcaataggcagtactttttttctttctttttagctctagcatctatcacagtgcttgtggtcatggggtacatactcagtaaaatatcttttactgaactcaactagatcttgggggaaaaggggtggagtcattcattcattcattcattcattcaacatatgtttattgagaagctataaacataggcacaaggttatgtgctaggtagtgcgattacaaccaagaagataacccagggcctacttttggtctagtgaaagagatggaattagatgggtatggtggtgtgcacctgtagtcccagctacttgggaggctaaggcatgagaatctcttgaggctaggagggagaggttgcagtgagctgtgatggtaacactgtactccagcctgggtgacagaagaagaccctatctaaaaaaaaaaaaaaaaaaaaaaaaaaagtagggcaacataaatacacaattttaatttaggtgggtaaagacaacagtggaccccagggcacagtttagattattttatggatatggataaacagagaaaagggtggtttttttttttttttttaaatctattttagagactgggtctcactgtgttgcccaggctgttttcaaacttctgagctcaagtgatcctcccacatcagcctcttgagtagatggatggcattttaattagatgaaattgtactaggaaaggcatttgcaaaacaaagtaattgccccaaatcactatgaaaccctaagtcaggcataaaactcacgatttctgacccttcttcatggcctattgcctcctattacctttactttttcaagtaaagatattcttctggtaaacacatggtcaaatacagtgtcttgggtaacgaatagtaaagtgagataacatatgtagagaaagcgggtgagaatccgtactccataaaagtattttctttccataggtgtctgctaaactgccatctaagttttccaaaacaaaaaacaaaaacacttgtgtggtgctcaatgatgtatattaagtgaaacctaccaactgacctttatcctttccttcctgtttttttaatattaaagaagagacctcttttcacaaatgattgaggaggctagtaaaatgcagtgaaaagagcaagttctttgggagtcagacagcatcggatccagcccagagcgcagcacgactagtagagtaacttagattaagtccttaaacttccagtgtcctcttttgtaaactgggaataataataataataaataaatagtgaataatatttatgcaaagtacttagcacagtgtctaacacataaaagcttaggagaagttggctattaagcatttctaggaacccgaggactcagggttgttattttagttcttggaatcaaaggaacttgaagcgtagtcattcctaaactaagttaaaccagaactagcgctttcagcaatgatgtaatttgatctcttcgggccaccgtcgctgagcatgcgcaaataaacgtggcgggacgtatgtgtcatggcgctctccatctaaagtctgtgcagcttccggagagtggcgggttgattttctcactttggactggtttttacttcccgacttctgggtaagggtggccgatgggtccatgtggggcagagtgtggccacagctccttttatggccaagccttgtttctccagtttcagtttttcttgggctgtttgcaaatttgtttcgcagttaaaaggggatttgccagctgggatgggggaattgggaggcagatggggcttccaggagcgaggatagggtcgttggcctcaggtgccgctctccagttaggagtattttaggcacctcgttccttattgtcaggtttaacttcatttgttctcccactttataccttagtgaatttgtagatgtgacaaggctttcgcagttatatagctttcccagatcagtatgttaagaatttaagcagaagttattgagaaaagcaggtgtcttgctttttcacttttcgttcttctttgctcataaaacctttttctgaatctcgggacgacagttatctttcggatggaacgtgatctggatgtctatctaccttattgacttaatcctgttttgtagtggttggttactcgcactatgcagacgtgttgcggtgctgaatacaacatttattactaaagccagacactggatcaccgtcacggcagatgtcagcacacctgttgtaatcagtaagaagttacaagtagtatggagcatcattaatcctgctgtataaagcagtcttttatggagtctgattccttttaagtaaagaatccttacagtggttttgtgaactttttgggtgcttacttttcctaatcaatttttattttccagactcatctttcaagaggactttagactaattgcagataattaaggtactgatttattttaaaccttttatgtttgagtgctgtgcgtatttctgcatgttagaaaatgcagagaggtagcctaatgttttagctatttgccactatcatgttatggaaacattgtgctttacatagcattaaatcgaagagatattttcatttattttacttaacctttcattttcattcaccagcattgaccatgtccacttttttgagatgcccttttcatttgccttccatggcccatggatttttttccttgtctggtggctgcttcttggaatccattataagctgattttcctttatctggcagttaaatttggagtctctcaagtcgtggtcttgtaccttctcctacctctgttctctttttcttcccctctgggtgatgtaatccacatgcctgtcaacagttatttgtctttttgattctacccatcctaatgggtatgaagtggtgtattattgtggtttggatttccatttccctgatggctcatgatgttgacatcttttcatgtgcttatcagccatttgtatgtgtgtgtttttgagacacggcttccctatgccacccaggccagagtgcagtggctcgattacggctcactgcagccttgaccacctggtctcaagtgatcccacttcagcctcccaagtagctgggactacaggtgcatgccaccatgcccggctaaattttacttttttttttttttttgtagcgatagggtccgtgttgcctaggctctggccttgtactcctggcctgaagtgatcctgccaccttggcttcccagtgttgggattataggcatgagcctctgcacctggcccatttctgtatcttcttcatctaatctgtttttccttttgttgcttgtgcttttcatttcttagctaagaaagaagggcctactctaacatcataaagatttgtgcttatgtttttttctaagagtttcataatgttagctcctaaatttaggtctatgatccattttcggttaatttttgtatatgatgtgaaatgtgaaatagggctccaactttattttttacatgttgctatccagttatcccagtgtcatttgttgaaaaaaaaactacgctttcccccttgaattgtctaggttatgtatatttgacatacattctaggtggtttttatgaaagaataattctgggacagtgattatcaaactttaattcagatcaaaatcacctagagggcctgttaaatattgctaggttttactcaaaatatctgatttagtatgtctggagtggagttcaagaattttcatttctggctgggcatggtggctcatgcctgtaatcccatactttaggggccaagatgggaggagtttgagaccagcctggacaacaaagcgagaccttgtttttacaaaaaaactgaaaaagaaaaaatgttcatttctaacaagttccccatgatgctactccagctgatgtggaaactacactttgaaaaccactggacattgctttgcaactgtggctgtacacacatgagaatgactggaaagtttttaaaagatattgatgcccaggctccattctcagagattcattcagctatcttggggcttagttgggaattttcttttttttcttttgtttttgtttttgttttgagacagagtctcgctctgtcgcccaggctggagtgcagtggcgtgatctcggctcactgcaagcttagttgggaattttcaaaagctcttcaggtgaatagaatgagtgttgaagattgagaaccattactgtggaatcgtggttcttaattagggatctatagtggaattacctggacagtttctatgttcacatacttcagttctactcttggagattctaattcagaatggaacctggagatttgatatgatgaaaagcttcccgctgggtgcagtggctcacgcctgtaatcccagcactttgggaggccaaggcaggtggatcacctgaggttgggagttcaagaccagcctgaccaacatggtgaaaccccgtctctactaaaaatacaaaattagctgggcgtggtggcaggtgcctgtaatcccagctactcgggaggctgaggcaggagaattgcttgaacccaggaggcacaggttgcagtgagccgagatcgtgccattgcactccagcctgggcagcaagagtgaaactctgtctcataattacaaaaaaaaaaaaaaaaagcctccctaataactcacctatgtaagtaaccactgctctaggatattgcatcctccttcttcctatcattttgagtattttccttttcactgactctatttttattccctttatcaaatttgatttcctctacctttgagaaaaatttttaatgatccttttgctccatttagctattacgctgctttccttttattctcaaactttcatttccatatgatttaattaaaaatttctgaaggctaaacaattccctctatcagtctatcagtttgttcaaagtaaaacctttagcttattaatagtgatgagtgagattatttaggtacttatgatatacagccaggtttatgctacataatgctgatatgcagcgttatatttatcttttttgagtgaatatctccaaatgaaattgctggctcgaaggatatacatatgtttggtataattgtcaggttgccctccagaaggggtgtaccagtttttctgtgctttcagctaacagagtttttgtcagctttgtatcagtgaggcagctgaaaaataacttattgtttcaatacttgttgttagtgtggttgagcattctttcctctttttttttttttcttttctgggtatttgtatttcttaagtgaactgcctgtttttcctttacgcattgttttctggaatgtggttacttattagtgtcacattagattcttgcattgtttgtactttgccagtgaggcaaagccatagtgggaagagcatggtattgagaggatgccaaggttctgatttctagctctatcaatgtacaaatccttttgcttcagtggactccagctctgtaagataagaagcttagcaacttctgcttctctaactctaatgatatgggatgtctattgcagtggattcctttcattcctctttttcctttctatttctcttcagtggatccatacacacttgtatatgggatggcaaaattgtgtaattaaaaaatatggcttttaattaatgttatttaattattcatgatctgtcagtagttcttccgcattccaaaggcactacctggtcctagcctctctcatttaattatttcatagaagagtggtgatagaagaaatcctaggggttgggcatttacttcagcttcccacccagtgtagaatttcctgctgtgtcatagaaagactagctaaattcaacttaagcattgtgttcattcatttagtcagtaactattgtgtgcctgctatgtgtcaggcattgttagaggtgttgtagagacagtactgaaaaagagatgatgcctttgtgcttaacaagcttacattgtaatgaggaagatacaattatatatgtggtgtcaggtaggtaagcacaatgaagaaacatgaaacaaaagcagggttagaagcagtgaaagtgtgggcatgcttgggcagcgtggttattttagataaggtagtaggaaaggcctctccgaggagatgttgtttgagtgaagaagtgggtgggaagacatacttatctgggggctgatattctggcagaggaatagcaattatgaaggctcccgagtcagaaactaatttggcatactcagaatatctatatccatatattgcccgactgtgtagtctgcagtaaaagtatttattgagaacctgcaatgtgctagacatagttctaggcacctgggataaaacagtgaacacctcacacgaaaacctttaccctcacgaagtatgtattctagtaagataaacagttaaaaaattattaaaacattttaagcagatgattaaatgctacagtttaaaaaaaggcaggaaaggggcataggaagagggtgtgtggtgaggtgggggtgttggttggaaagtcctctcttgttacacttgagcaaagtccttaagggcttgagtgagtgagccattcaggtgtcttaagtaagagcattccaggcaagaataagactgtgaaatgaatgcatatctagtgggtacgaaataacaaagcctgcatgactgaggggagcgtggtaggaagtggggccagagatgcagcaggaggctgattatatatgtcattgcagatctttgtagtgattttggctttttactctgatatggaataccactggaagggtttgattgagaagcttgagatgaacttaggttttaaagggatccctgacttctgtgctgaaaatgttcttgtagagtttaaggatagaagcaaggatattagggattgcaataatccagacaagaggtgatgttggtttggaccaagagtgtaacagtgggtatggtcacaaatagattctgaatatattttgaaggtacagccaacaggatgttgttgattgattggatttagggtgacagaaagaggggagtgcaggatttttggcctgagcagtagaagattgggattgtcttttttttttttttgagacagagtctcactctgttggccgggctggagtgcagtggtgagatcttggctcactgcaacctctgcctcctgggctcaggcaattctcctgcctcagcctcccaagtagctggggttacaggcgctcgccactatgcctggctaattttttgtatttttagtagagatggggtttcaccatgttggacaggctggtcttgaactcctgaccttgtgattcacccacctcggcctcccaaagtgctgggattacaaacatgagccactgcgcccagccaggattgccattaaatgaaatgggagaagttgtaagaggatctggtaaggtagggagaagatcaggaattctgtttcgactttgactttttttttttttgggatggtgcttcgccctttgtcgcccaggctggagtgcagtggtgcaatctcagctcactgcaacctctgcctcctgggttcaagcggttcttctgtttcagtctcccgagtaggtgggattgcaggtgcccaccaccatgcctggctaatttttgtatttttagtagagacgaggtgtcaccatgttggccaggctgacctccaactcctgacctcaggtgatccatccgcctcagcctcccaaagtgttgggattacaggcgtgagccaccatgcccagccctgttttaactttttaagtttgaaggaattattagacattcaagcagtggtgtggaataggcagttgaacgtctgagtctgaagctcgggggaagaatggggctggttatgtaagcatagacgtagttcatatttcaaggccatgggactggatgaggtcacctagggagtgcctgaaactagagaagagttcctgtaacagagccatgggggcattctaatggtgagaagttggagagatgagcagaggagactggagctaggagagtgtggcatcctggaaactagtgcaatttcttactgcagttcttcagtctttaataatgcacactgtgaatgggtaaggacgcagaattttctaaatttatttgaccacagaaccatttttttttccagataggtagtaaataattagaagcaatttgggaaagactaacctggttcatttcaccctacctggatggctgagttggccagggctcttttttgcaagaacagaatacccacctcaaactgatttaagccacaggctcgcatgactgggcagagcagggctgcatttggcttcaggcatttgttggattcagatgctcaaataatgtcagtatggttctttatctttctagatcttattaggcttcattccttaagtaggcttcctccctgtagcagacaagagggctctggtatccccaagttgacatcctcccaacttagccacttcagtgacaagagaagctatcttctgttaacactagcgtagaatcctcacagtgattcttattggctaggcttctcatgactgaccttgaactggtcattgtggccaggaggatgagttaccctggcaagcttgggtcatgttccccattccagtgtctagggaaagggaagtctgtgattgacagtcttttttttttttgagacagagtttcgctcttgttgcccaggctggagtgcaatggcgcgatctcggctaaccaaaacctctgcctcccgggttcaagcaattctcctgtctcagcctcctgagtagctgggattacaggcatgtgccaccacgcccggctaattttgtatttttagtagagacagggtttctctatgttggtcaggctggtcatgaactcccaacctcaggtgatctgtccgccttggcctcccaaagtgttgggattactggcgtgagccaccgtttccggcaattgacagtcttaccatgaccacgtggtacgtatgttaactataatccagccaatccttgatggattgatgtttggtttatttctaatctttggttcttactgacaatataaagctagctgagatttgaacacagatttttcggatacccagtgcataatttgtcatagctgtaatgaatacattacagaggaaaggagcctggctggctgccactctgttaattgaatgatgtgaatggaaggatgggaatccagcaaatgagaaggaaaattcatcagaaagctttgaggacaactgaa

SEQ ID NO: 1189 - DNA, 1888 bp, Homo sapiens
attatattttcataggagaaatgggacatgaaagaggctaagtcaccgacaggctcacacaaccctgcctccagagtccaaggtttggggaacgcatccaacccctcctcacccgtgacagagataccaggagagattcgagaggggatgggtgggggaggaccaattccacgacctgtgatattcgagagctttggagggagccctcggtgtgaccccttccgactgggtgtcttagggccatttaccacttcaggctacagccagtgagaccgtggtggagacgaaatgagggtgcagtgcgtgctacacacgaagcgctggaagggaggcatcgtgacggcggctgtgaatggcgtgtgtccatcaagtcacgctccgcttaccccactgcgggcaaacaggaaacatcaggaatctgatgctcaaggagggtcaggaccatgctgagcgcacccagaaccagcagaggccctgggcaggaggtccccaaccaatccccactcgctcaagaatcacacggtgttcagccccctcctccctgagacccaggagtccacgaccccaggccctccttcctcagccacagatgcctggggtccccagtcccacttcttctaggcttagtcctggccctctcctctctcagacctaggatggtcccccagccccctcctccctcagagcctgaagcccagttcgagacccttcttccctgagacctcgaagtctggggtcccagcttcttcagggtttcaggtgaatgggcccccgtctccttcccaaccccacatggaaggccaggtaaggtaacgggtttattcacagtgtcatttacaggcagcccccaccccgcggcatcagatcccggcgggaggcccgaagtcgctagaaggtggggacggccttggaggcggggggccgggccggatccccgggcgtccccggcgtcgcctcctcgtccagaccccggcggcccttgccgatggccaggcggggccggccgcggttcaggccgtccaggagcgcgcaggcctggcagagcgcgcggctggccagcgccccacagcgggagcaggcgccggggcgcgggggccgcgcggccggggccagcgccaggcgctcggccgagtgcacgaggtccagcaccgcggacggccgcgccgcctccaggcgcttgagcaggtcccgggcgtggccgcggaaggcctcgggcgcgtagacgcactcctcggagaagtagtcgaggcggcggaagtgcgcgtacagcaccacctccttctgcgaggcgaactgcagcgggcggcagcgcggcagggcgcccccctcgccgggagagcccaggcccccgccccgggccagccgccccgcgtcgccccgtaggaagttcatgagcacggtctccgccatgtcgtcggcgttgtgacctggtggggagagaagggagcgggtgaggtggggcgcggagggcgctgctggccagggagccccccggggaaccaagggtccaccaggacccagagagagactgggaggagagacccacggagacccagggcacagtggggccgccaggacccagagagagacggcgacggggagagcaagccatggagacagacccccaaacatggtgtgacagccaggatccagagacagggagggggagagagagccatggagacccctagggcactgtgggcaaccaggacgcagagagagacggggagggcaagagcgagccatggagaccctccgggaaccgtgaagcagccaggtgcaggctgcaggtggacacaacaaaaaatcaaagagaaacataagctcccctggcgcaacttgggcgtgccttcatgtaccacccgcctactgcatagcggaccttatg

SEQ ID NO: 1190 - DNA, 3085 bp, Homo sapiens
cttttagattcttctacataccagttaaaaaaaattggtgctgaaaacccattccttatgtcactgagctaatgaggaaggcaggcacacttggcactaggactggcacacaagcgtcatcctatacaattgatcttgatcatcttgcaccccctacagctcattctcctcacagcagctggagtaacttttagaaaatggaaattggacccactgttgggaccaaagccctccaaagacctaccatcactcttaaaatacaagtctttcttgccaacagaagaccatgcacggcccatccctgcttagtggctcgtttcatctcttgctattctcctcctcacccactctgttcccgccacactggacttgctgttccttgcacttgcaagctgattcccacccctccaggcttttgcaccagcagttccctccaccaggaaagctcttcccccaaatggctccatgctttgttcttttgcttctgtaggtctgtgcataacgtcacttcctccaaggcccttccttccctgacccctgtggaaacaagctcttcctgtctctctctctcatcattttttttttaatttgtagcattcatcactacctgacattacatattgatgtgcttgctgtccgtttctcccagactgaacttcatgagggcagagacttgtctcctgttcactgccatgttcctagaacccagaggagtgcctgatgcaaaggagatgctcatacacgttttgagtgaatcatctagtccttggcctccagcccaagtttgggtggccacacagtgaagacaggactgagaagcaggggtttgggagaatactaagccctgggttgggtgatgggaggagagaattgagaagccttctaggaggaccctggaggatctgagcagggtgatgggaagaaggggcatttctgacaagaagccagcccagcaagtcctggaggtgggactgagagcaccatctccccgggaagtttgagattctcacaacctccccgtacctgtacaggacagcaaccctgagacccggcgccccctggtggtcagacagtaacatgaacgaccaagtccaagtggtcaccatttattgagcacctcaacttctctgatcttccatttcctcccagtggtgccttgatgcgggggggatgggggggcgggggggaagggggctgattatattttcataggagaaatgggacatgaaagaggctaagtcaccgacaggctcacacaaccctgcctccagagtccaaggtttggggaacgcatccaacccctcctcacccgtgacagagataccaggagagattcgagaggggatgggtgggggaggaccaattccacgacctgtgatattcgagagctttggagggagccctcggtgtgaccccttccgactgggtgtcttagggccatttaccacttcaggctacagccagtgagaccgtggtggagacgaaatgagggtgcagtgcgtgctacacacgaagcgctggaagggaggcatcgtgacggcggctgtgaatggcgtgtgtccatcaagtcacgctccgcttaccccactgcgggcaaacaggaaacatcaggaatctgatgctcaaggagggtcaggaccatgctgagcgcacccagaaccagcagaggccctgggcaggaggtccccaaccaatccccactcgctcaagaatcacacggtgttcagccccctcctccctgagacccaggagtccacgaccccaggccctccttcctcagccacagatgcctggggtccccagtcccacttcttctaggcttagtcctggccctctcctctctcagacctaggatggtcccccagccccctcctccctcagagcctgaagcccagttcgagacccttcttccctgagacctcgaagtctggggtcccagcttcttcagggtttcaggtgaatgggcccccgtctccttcccaaccccacatggaaggccaggtaaggtaacgggtttattcacagtgtcatttacaggcagcccccaccccgcggcatcagatcccggcgggaggcccgaagtcgctagaaggtggggacggccttggaggcggggggccgggccggatccccgggcgtccccggcgtcgcctcctcgtccagaccccggcggcccttgccgatggccaggcggggccggccgcggttcaggccgtccaggagcgcgcaggcctggcagagcgcgcggctggccagcgccccacagcgggagcaggcgccggggcgcgggggccgcgcggccggggccagcgccaggcgctcggccgagtgcacgaggtccagcaccgcggacggccgcgccgcctccaggcgcttgagcaggtcccgggcgtggccgcggaaggcctcgggcgcgtagacgcactcctcggagaagtagtcgaggcggcggaagtgcgcgtacagcaccacctccttctgcgaggcgaactgcagcgggcggcagcgcggcagggcgcccccctcgccgggagagcccaggcccccgccccgggccagccgccccgcgtcgccccgtaggaagttcatgagcacggtctccgccatgtcgtcggcgttgtgacctggtggggagagaagggagcgggtgaggtggggcgcggagggcgctgctggccagggagccccccggggaaccaagggtccaccaggacccagagagagactgggaggagagacccacggagacccagggcacagtggggccgccaggacccagagagagacggcgacggggagagcaagccatggagacagacccccaaacatggtgtgacagccaggatccagagacagggagggggagagagagccatggagacccctagggcactgtgggcaaccaggacgcagagagagacggggagggcaagagcgagccatggagaccctccgggaaccgtgaagcagccaggtgcaggctgcaggtggacacaacaaaaaatcaaagagaaacataagctcccctggcgcaacttgggcgtgccttcatgtaccacccgcctactgcatagcggaccttatg

SEQ ID NO: 1191 - DNA, 3888 bp, Homo sapiens
tcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcact

SEQ ID NO: 1192 - DNA, 21112 bp, Homo sapiens
tcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagagacaggtcccagaggagacaagagctgagagaccatccaaactgggaccaccttgtcactagacttcaaattttcaatattgatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacactgcctcagatggttatcaaggggtaccctaagaagaaatcatctcaccctctctttgtccccatttgtcaagtagcagtgaggccgagccaggggatggtgaaagtggaaggaggtgggagttgggcatcgggtgtgaagatgctcttgaaaggggttttaataaccacttgctaccaggccagtgaacacttaccatagttgatgccttttgagcatgttgcattgtaaactgtccctgaaattactgtgcacttggcttatgggatgaaacatcctcctagttcttttgtctctcagcttctctgaagtctcattgagcaccttctcttcaatttcttttacacagtaagaataggatcagctgtgctaaactaacaaatacccagatatccaggtttggctcatgttacacgtccaaagtaagtcatgcaggaagctctgctcatcatcgtactcaggaagtcaggctgacagtctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacacactaaataaataataaaatacttctacaagagatatttatggaggacctactgtgtaccaggagcaatgctaggcattatggatatcagcagcctttggctcctgaaaagcttacacactacctcctggcctaaggaggggcacagggatgctggcaacagtctatttcttcacccgggtactagttacatgggtgcttgcggtgataaccattcaacgtacattctattggtttgtgtgtttcttccaaatgtcccctagttcacaatagaaagggcttaaatagagaagtaaaggagaatttgggaatttgaagcaaaagcaagaagccactgaatcaagcacaaatattgagctttgataaagattggaataagaaacataataaatgagacaagaaataggacttttgcaactgaagtgtaattaataaacaaaaagccaaactgagaaactgtcccaaggacaatatgatcgagtaaacaatagaaaatgtaaaggacaagtgaagagaaatgaaggatagaaacagacatctgacatcttaataattagacgtctagaaagtcagggaaatagtggaggaagaggaaataactgaaaacataatagatgtttagtctttatagaaagatgaaataagttcattcaaaatgctgcatagaatgtcagactgttaaacaattttgttagagtaaaatgactgtaaacaaatgagctaattatgtgaattaagaggatggaaaagcagaaaaacagcaaaaagaaaatacatgtaaataataaggacaaaagctgaattcaatgaaatataaaaatagagaagataaaatcaaattttgaggcaatgaaaactttaatgagacctctggcaagactcctaaggaaaatacaggagattcagaacgaaaagggtaaatgacatttatacacattttaaaatgcaaaatcttacgaccaactctatacatataaatttgaaaatttagataaaacggatacgtttctagaaagatataaaggtcaaaactacaggaagaaatagaaaactaaaatagagtagagaatatcaaagaaattgtcatgggaagcaaagaatcgccttccaaagggccctgtcctgatcttattgcagatgagggtgtcctcccacatttccaggagcagatcatgcctcttacacgtgtgattctagaacatagaatggaacagaatttttgagatcattttatgaggttggttcatttatatttccagagccagctaagaatagtacaggagaacaggattgtggactaattttagccatgtcactgaatccaacagtacattataaaaacaatacgttttgaccaattttagatttattctaggaatgcaatgattcttcagtgtcagaaaatatataatgtggttaacacattagtggactccgcaaaattcatattaatttaaactgaattcagctcaagacatagacagaatttaatcaatttcatgacatgttaaaggtagtgaaccaaaaatctatagcatatatatttcaaagaaatgaggtggattgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattcctgctctgtaacatgaaataaataagaaccaacctccagatgtaaataagtgaacacatgagaagcacttagaatagtgcctagaacatagtaagcaactcaatgaatgtcatttctcattacatttgttaatgtttttatccagcccaatggcagtaaaacatcaatgctcaaagagcccctggtgaagtgtttctctttcccactcttcacccctaacttgttacctcgtcttttccactctgtccctaatacacctataggatgactcataggagcccctggacccggggatgctgtcagatcgcttggtctttgagacaatggtgccattaaggacccccgccaggcccaccagcaggccgagggcacagaccagcatctccatggtctcaggcacctggattagttcatggacctctggggcaccaagggaagacagagttataaggtacagagagcaggggctggccttggatgtgggaggtgttgggtattcgaaaccatgagatggtgaaatttggataaagtgaccataaaacatgggattgaggaaggcaggtgctgaggggcgatgggcccaggaaataaaggtggtgccaaggccgtgagggcagagggagggcgctccataccccagtgcctgaggagaggctggtgcaggccccagtgctccccctggaggtcacaggtgtcctcggccatgggaacgagggtcagatagtggaacctgtgtaatctgagtttcttgctgggcaggaagatggtctctgcaataccctcaatgactggctccccattgcgcagccacgtgatgttcagcactggtgggaagaacttgtcaacatggcagacgagggtgttgggctggcccagatccacaggctccttgggaaagacgcttacctcggtgggggctccaaaaggggatagaacccaaggagcctactgccattggctgattcttaaaggttccaccaccccaagtcctatattcaccagattaggggccacctctcccaggcccatcctcctgctcccctagggctcctggacagggtcacagcttctcgtgctcctgacctggccccctcagcccagcctttctcttgagtaagaagaaaatgcctcctcctctgctgtcctaagaacccagctgtgtggacccaagatttctcgctctcagggaaggggctcattcatgagtgggcatcatggcctctagttctatgtgtggcagagaggccctcccatccctccagctggactctagaggaacaggcagctataggcagtgccatttgtggcccaagtctgtttggaccattgatccgggtgttcaagtgcttccttgccatgacgatgccagcaatacccctctgagaggaacaggcagctataggcagtgccatttgtggcccaagtctgtttggaccattgatccgggtgttcaagtgcttccttgccatgacgatgccagcaatacccctctgagcaccaaagtcaaaggtgtgaataaactctggtagaggccagaccatctccttctcatccaggttcacgtagaactgctcctcctcatcaaattcaaacatatactccccagagggtctgtgcgtctgcacaaactccgcatatgttgacacatggtctgctgcatgaaggagaagatggagaatgggtgaatacgtaggatgctacacagaatgcaggaagcaaacaggtaacaggaaggttattgggaacatgaaggaataacacagaaaatgagaaatgcaaatgaaagaaaagaaaaggagtgagaagaaacaaagacagaaatgacccatggacgatataggttgtttcccttgtccctgaagacttaacatccgtctatgataatggtaatgctgaatacagtaagataatatttattgggcacttactatgtgctaaacttactcattgaatcttcacacccccatgtagaagaacttattttccatagtagggaactgaccccagaggtaaagtaacttgtccaagtcacacaactcctggtagaaacaatattgagtagtcctcctacctcattcctgtaggatctcagaaaccctacaggacaatacattaaaaattactgatatagccataaagcaaggcagggaagtggaaggatggaataaatatttcagagtggaacaaaatcgtgaaggacatgaaaatacctccagagtcttagtgacatttatagacttcaagttacattcttacttttagaagaaaaatgataccttctataattttatccacaacacttacattttaggcagagtaaatttaaaagtattatcattcacataacattcacaaaattgtcttgtggagtgtagttttcaagtgtagtttcacctggaaatacaagttgttggcatttgaaagacctatgggatagtatcttagctttacctgatacataagaagcagcaactggttgataacaaaaagtgaattattattacagtgaattacagagagtttagggttcggcctggaagaggaagtgaagccaaatgacactgcatggttggtggtccctaagtgaggatttcccctcccagcccagcatggggagaaccagtcctctacttagatgcatagtgtgacagcaggttcagtgccgcacacggatggtgagggtcccccactgagtttagggtctagaggattactcacctacagaaatgaatcccaaaggaaaaagaaaaatacatggtgtatagactgggctacacagatgtaattggttcagcttaggttactttgtatttattatatttacaaaatctgaaaactaaaggttggcacattttgaagcaaattccacacttcaaatgttaattttcattcagttaataaatgctttttgtgaactttcactctctaggtaataaggatgaaactctaaagatgggaactttgtccttaatctacttgaaattcaagaataaaacagacaaagaaaagatgattgctacatgtgtggtttgatcaccactgagtatcacaaggtatacacaagagctactcaggagcaaaattaaaatacgatttaggaaaggttcctagggacagtgttcacctgcagatagcaaaacagagaaaggggaaatggcatttccagcaggagaagcaggctcaggagcagagaggcatgaagttgcaaggagaactgcagttcttcagtgtgactgaagccaggggagatgtgggccaggcagcactgtaacctgccttgtgtgctgatggcaagtgtttgcattttatcccacaggacataggaagttgtgaagtatcttaagcaggagagtaacacggtcagatttgtgtttggatggggcacctgtaggaaggatgggctggaggaggcgggactcaaggcaagaccagtagcacttttaagccctctggtgggaagtaatgaaggcgtaggccagggcaggaacatggggtgaggaggacagcagatggatttgatggcagtaatgacatgagaggccacaggaatcactaaatcacatgccagaagtagggatatgaagaagtcgagaataaccacgcaacgtggagaattgtggcatccgtgcctgcaaaggtgataattaagtgattgagagaaggtaaaattttctgtttgagacatactgaatttaaacttctaggggaaaacatacagttgatttgaaggcagtgaaataaatggatgagtgtcatgctacattaggttagtgacataaactggaaggaggctcatggtgggtgaagttctaattttgggtcaggtcactcaagaaaagtacacaaagtcaggatagcagggatctgagtgtgtgctcctgcatccagacaaacacagacatgaagaaagaggctgaaaagcagaggactagaaattggtaggaaaacagagaggaagtgggttcataaaagacaagagacaggagaaaacttccaggaaagaggagagggggcatctcaaacacactaatgacacacataagacagaaacagaacagtgaccactggcttgagttgtataaaagtcattagttgccaccctgagaggagcatcagagatgagggaaagaaaaagagagagtacattgggttgaggactgaatgaaatgggagaaaatcgataataggctgggcacagtggcccatacctgtaatctcagtgatttgagaggccgagacaggaggatcacttgaggccaggagtttgaaagcagcctaggaaacatagtgagagtccatctctaagaaaacaattttggattccctgccttccatgagcaacacagcaaacataagctctgcagatgtgctcagacttgagcctgactcactgaagagagtgtggtgctgccaggcctcagacaccagattataatcaacctcttcccaggccctgcacaggagaggcccactctgtggggcatacagtgcccaggggtggtacaggccctgcagagaccacagactgttcacctgacaagaaatatcttgaggaactcacttcacagatccctcaagaaaggaaccactgcaggagaatacccagaaaatcgaaagaattcacagatccttttaaagaagggaggggccactgcaaactccaccagacaagtgaaaaactgtgcgttcccaaagcgtgagaggggaaaaacctgcctccggacccatgtccccactggggaactcgaaaatccagattacaggaaaaggatttaactttacctagacctgaaacagatttagcatgaaatacaaaagtacgccgggcgctgccgctcacacctgtaatcccggcactttgggaggccgaggcgggcggattacaaggtcaggagattgagaccatcctggctaacacgatgaaaccccgtctctactaaaaatacaaaacaattagccaggcgtggtggcgggcgcctgtagtgccagctactaggaaggctgaggcaggagaatggcataaacccggaaggcggagcctgcagtgaaccgagatcgcgccactgcactccagcctgggtgacagagtgagactccgtcgcaacaaaaagaaaaaaaaaatatatatatatggtagatgcagcagtgagaagagccttgtaggcacgcccagtctttagctcaagcccagggaagccacccctgactatatctcacaagggccctgggggaaggcagacggcaaaatttggaaggggtcacagtgtgaaaggagcgtccaactgaaatttgttataattctgactgggcacaaatcctctggagcagaatctgggggcgaacggaactgctggagaaagagcagaagttactgccaacattgtgggcagacagggaggcacatggcctgaaagctgtgcttgctttctcagcaggaaacttatagcctggagtgaggtctgagtccatcctgaaggctgcagggagataaattcaatgctgttagtgtggcacagcaggagcaaaacctgcctcgccaactgcatgggagctgggtgaagcctattgctaccaggtttcccctacttctctggtgacagaggcagccataatgccctctggaacataattccattggctggagaaaaaccctccgccccatccctcacagtggctgccgcaagccccccgcccgaggagagtctgagctcagacctgcctaaccctgtccacacctgagggcatttctctacccacctggtagccaatcacaaaagacgtaaactcttgggagctttatgacaccactcattgcctgagaaactgaatatttatcttggccaacttagggcaagcttatatccaccttctactattgtagctggtgccctcttgaaagcaccacatcctggctggaggccaaccaactcaggacattacaacaattcacgacagaataactgctctaagaaaggagaaaacagctaattccactggctgaaaaatcttgactaaccagtggtcttcggtctgttcacatgacaactgcactgctagcataaccagcatttgagaaagccaccacactaagtctatctacaaccaaggattctcacagagtctacttcactcccctaccacctccacactggaccccagcaatagatccaaactaagaagaaatctctgaattgctagatagagaattcagaaggttgattttaagctactcaaaaagataccagagaaaggtgaaaaacaacttaaataaattttttaaaaacacaggatatggattaaaaatgccccagggacgtagatatcataaagaagaaacaatccaacttctggaaatgaaagacacacttagagaaatacaaaatgcactggaaagtttcaacaataggatccaacaagtagaagaaagaacttcatagctcaaacaacaagcctttcgaattaacccagtcagacaaagacaaagaaaaaagaactttaataaataaacaaagcctccaagaaatttgggattatgttaaatgacctaagaatgattggcattcttgaggaagaacaaaaatctaaaagtttggaaaacatatttgagggaataatcaaggaaaacttccctggcctcgctagagatctacacaaccaaatacaagaagctcaaagaccacctgggaaatttatcacagaaagattatcgcccaggcacatagtcatcaggttatctaaagtcaggacaaaggaaagaatcttaagagctgtgaggcaaaagcatcaggtaacctataaaggaaaacctatcagattaacagcagcctataagccagaaaagactggggtcttatctttagcctcctcaaacaaaataatttccaggcaagaattttgtatccagcaaaactaagcgtcataaatgaaggagagataaagtctttttcagacaaacaaatgctgagagacttcaccgctaccaatccagcactacacaaaatgctaaaaggagttctaagtcttcaaacaaaactccaaaatacaccaaaatagaacctccttaaagcataaatctcacagggcctataaaacagtaatgcaaaggaaaaaaataaggaattcaggcaacaactagcatgagaaatagaacagtacttcacatctcaatattaacactctccacttaaaagatacagaatggcaggaaggataaaaattcagcaaccaagtatcttcagtcttcaagagtcatctaatgtgtaaggactcacaaaaacttaaggtaaaggagtggaaaaagatattccatacaaatggaaaacaaaagcaagcaagagtagctattcttatatcagtcaaaacagattttaaagcaacaacagttaaaaaagacaaagagggacattatacaatgataaaaggataactccaacaggaaaatatcacaatcctaaacatatatgcacctaacatgggagcttccaaatttataaaacaattattactagacatgagaaatgagatagacagcaacacaataatagtggggacttcaatactccactgacagtactagaaagtcatcaagacagaaagtcaacaatgaaacaatggacttaagttacactagaagaaataaacttaacagatatttacagaacattctactcaacaactgtagaatatacattcttctcatcagcacatgaaacatcctccaagatagaccacataataggccacaaaacaagcctcaacaaatttaaggtaatcaaaattatatcaagtcccctctcagaccacagtggaataaaattggaaattaactccaaaagaaaccttcaaaactatacaaatacatggaaattaaataatttgctcctgaatgatctttgggtcaacagtgaaatcaagatgcaaaattctctgaactgaatgataatagtgacacaacttgtgaaaaccactcggacacagtaaaaacagtcctaagaggaaagttcatagcattaaatgcctatatcaaaaagtctgaaagagcacaaatacaaaatgtaaagtcacacctcaaggaactagagaaacaagaacaaaccaaacccaaacccagcagaagaaaagaaataacaaagagagcagaagtaaatgaaattgaaacaaaaaaatacaaaagataaatgaaacatgaagctgattctttgaaacgatacataaaattgatagaccattagtgagattaaccaagaaaagagaggatccaaataacctcaattagaaacaaaatggaagaaaatgccactgatattacagaaatataaaatatcattcaaggctaatatgaacacattcacaggcacaaactagaaaacctagagaagacagattcctggaaatatacaaccctcctagaataaatcaggaagaaatagaaactgtgaacagaccaataaaaagcagaaagattgaaatggtaatttttaaaaaactgccaacgataaaaaatcacagattcacatggactcacagctgaattcaatcagacattcaaagaagagaattggtaccaatcctactgaaactattccaaaacagagaaggagagaatcctccctaaattattctatgaagccaggatcgccctaataccaaaaccaggaaaggacataataaaaaagaaaactacagaccaatatctctgatgaaaatagatgcaaaaatcctcaacaaaatacaagctaacataatccaacagcatatcaaaaagatcatacatggtgataaattgggtttcatgccagggatgcaaggatgatttaatacacacaagtcaataaatgtgatagatcacataaacagatttgaaaacaaaaatcatatgatctcaatagatgcagaaaaagcatttgacaaaatccatcatcgcttttttattaaaaccctcagcaaacttgacatacaaagatcataacttaaggtaataaaaaccatctatgacaaacccacagccgaccttatactgaacggggaaaagttcaaagcataccccctgagaactggaacaagataaggatgcccactctcaccacttctattcaacatagtactggaaatcctagccagagcaatcagacaaatcagtaaataggaagtcaaactgtcactgttcaccaatgatatgactgtatacctagaaaaccataaatacttatccaaaaagctcctagatctgataaatgaattcagtaaagtttcaggatacaaaatcaatgtacacaaatctgtagcactgccatatactaacagtgaccaagctgagaattaaatcaagaactcaaccccttttatagtagctgcaaaaaaataaaatacttaggaatatacctaaccaaggaggtttactgggggaaccagcccccaatatttcaaagtatgttcttttctattttccctaagtgtgggccagtctgagaaataaagagaaagagtacaaaagagagaaatttacagctgggtctccgggggtgatatcacatgtcagcaggttccatgatgcccacctgagccgcaaaaccagcaagtttttattatggatttcaaaaggggtgggggtctatgaatagggaatgggtcacagggatcacatgcttcagagggcagtaaaagatcacaaggcagagggcaaaactagaatcactgatgaggttccacatcccgctgggcacacattgtcattgataaacatcttaacaggaaacagggttcgagagcagagaaccagtatgactagaatttgccaggctggaatttcctaatcctagcaagcctgagggcactgcaggagaccagggcatatttcatcccttatcttcaaccatgtaattcagacactcccagagtggccattttagagacctcccccgggaatgcattcttttcccagggctattccttgctgacaaaagaattcagcgatatttctcctatttgcttttgcaagaagagaaatatgactctgttctgcctggccctgcaggcagtcagaccttatggttatctcccttgttccctgaaaattgctgttatcctgttcttttcaaggtgcccagttttcatattgttcaaacacacatgctttacaaacaatttatgcagttaacgcaatcatcacagggtcctgaggtgacatacatcttcagcttacaaagatgacaggattaagagattaaagtaaagacaggcataggaagttataagagtattgattggggaagtgataaatgtccatgaaatcttcacaatttatgttcttccactgtggcttcagccggtccctccattcagggtccctgacttcccgcaatagaggttaaacacctgtacgaggaaaattaaaaacactgccgaaagaaattatagatgacactaacaagtagaaccacgtcccatgctcatggaagggtagaatcaacattgtgaaaatgaccatactgccaaaagcaatctacaaattcaatgcaatccccatcaaaatgccatcatcattctttacagagctagaaaaaaacaatcctaaaattcatatggaactacaaaagagcccacatagccaaagtaagattaagcaaaacgaataaatctggagcatcacattacctgacttcaaaatatactgcaaggctatagtcaccaaaacagcatgggaatggtataaaaacaggcacatagacaaattgaacagaatagaagtcccagaaataaaaccaaatacttacagccaactgatcaaacaaaaacataaagtggggaaaggacagcgtattcaacagatggtactggggaaattggcagtccacatgcagaagaattaaactggatcctcatctctcaccttatacaaaaatcaactcaaggtagatcaaagacttaaatctaagacctgaaaccataaaaattctagaacattggaaaaactcttctagacattggcataggcaaagagttcatgaccaagaacccaaaagcaaatgcaaaagaaacaagataaatagatgggacctaattaaactaaaaagtttcttcaaaggaaaagaaataatcatcagagtaaacagcccacagagtgggagaaaatattcgcaagctatacatacaaaaaaggactaatatccagaatctacaaaaaactcaaacaaatcagcaagaaataaacaaatactcccatcaaaaagtgggctaagcagaggaacagacaattctcaaaagaaaatatacaaatggttgacaaacatatgaaaaaatgctctacatcactaattatcagggaaatgcaaatcaaaaccactatgtgataccaacttactcctgtaacaatggtcataatttaaaaataaaaaaaaaaatagacgttggggtaggtgtgatgaaaagagaacacttctatgctactggtgggaaattaaactagtacaacctatggaaaacagtacagcgatgccttaaagaactagaaatagatctaccatttgatccagcaatcccactactggaggaaaaaagccattgtatgaaaaagacacttgcacacacatgtttacagcaccatgattcacaattgcaaaaatatggaaccaccccaaatgcccatcagttaatgggtgaatgaagaaaatgtgatatatatatatgtgatatatatatatgtgatctatatatatatagatctatatatatatatatatatatagatcacatatatatatatatgatctatatatagatcacatatgatatatatgtgatctatataccttagaatactactcagccataagaaagaatgaaataacatttgcagcaacctagggggaattagaaaccattattttaagggaagtaactcaagaatggaaaaccaaatattgtatgttctcacttataagtgggagctaagctatgaagacacaaaggcataagaattatataatggactttgaggacttccaggtatgagtaggagctgggtaagggataaaagactacacactggatacagtgtacattcctcaggtgatgggtgcaccaaaacctcagaaatcaccactaaagaacttatccatataaccaaacaccacctgctccccaaaaactattgaattaatttttcaaaatgattttttaaaaaacttttattggaaggaccctccggagttctgaggaggaggcctgagcatatgtggggaaggcacagatgaacacataggagggatctctaagaaaacaatggccaccaggtcactgctagactcaccacagggccttctaaaccagggggcccctccacgagcataccctgtggagtcaaaggttaaaactcacaggtgacagggccagcacactaaaccccacttgcttctcctctttccaccacctcagccctgtgaccagcatgacttacaggttccagcactgcaggctctctcttctctcccttcagcccccggggcccatgggcagcctaagggagacacacatgtaaccccagtggggcccatgagcagccaggacaccaggcctgcccccatctcaactccaacctcgattttgggtcctctggagaccagaccagccctacccacaagccccacaggcttcctctaaatacttctgttcacaaaactctcatgcctgccaaggagatctcagggttccctgcaccccagttctcagtcccacctcagcaaacacaacctctccaaatcctgaagagcctctttcagaaagaggactttgagtctttcagtctttctccaaaaaagaaaaggtatatgcccttatgcacaaaattttatttagaatttgaaggagttcaaaaatgtaaaaaccctgcacaggttaagtatccatactccaagtaaatttggagagcatttcccagagatattccaaactcaggcctcataactgccttttgcaaaacatacagttcttgggctcagttatccaagccccagagcagccccctacaatgcaccccacagttcctctcccagcaggatgctttgcccttcttctggccctcatgtacactccaagccaaccagttccctcccttgcacacctccattcagatgcctgttcccaaatccaggccatagccaagataagggtggggagaaggtgaaacattcaccaccaccccaactccccaaaacaaagatcttcagaatgcccctctccaccttcatcctgacagcaatgatccgtttcaaaattctcccagatcccacatcaaccccaaagacccagacagcagcataaaggaaaggcagcagaagctcacgggtgccaagagcaggaggtgtgggatgcagcagcagggtagaaaaggcagccataactgcaaggcaggcagaagatgtagcagagtagacaggaagcagtccaactgacagagaatactggaagatatgagaacaactaagggacacaaaataaaatgacaaacacttggatgcaagagtgatgccagggccaaggaaaattaaacatggccaagatggccacaaaacaaactggacaaacaggaagtggctgtacagacaggaagcagccaagaaaagaggatctgggaagtgaaccttcaacaatatggctaccatgacccagagtgaaaagaaaggcacaaaacaggtacaatgggactcctgcagagggaattatgcatgcaaggcttagtgggtagatgagcgggaggtacagagtagatggaatcagatgagtgaatagatagatgggtggaattgaatacatggttgagtgaacggttggatgtgaagtgagtgggtgaggagatgggtgcatgagtgtattgaaggagagagtggttgagttccaggaaggataatggatagatgggtggctgaacagatgcatgcatccttgtatgcatgggtagatggggtgtgtgagtgggtgggtgagtgaatagatggatggat

SEQ ID NO: 1193 - DNA, 10530 bp, Homo sapiens
gtgtgctttatgaaaagtatttatttgatacttattctctcctcttagacaatttaaaactttctattacatacctccatctttttaaaaaatttttaagcaacacataataattgtacatatttgtgggggtgcagagtgagatttttatacatatatacaatgagtaatgattgaatcagagtaattagcatatccattacctcaaatattcatcatttctttgtgctggaaacattcaacaacctatctatttgaaattcatctatttgaaaacatacaataaattactaactatagtcaccctacagtgctatagaatactagaacactagaacttatttctcctctctagctgtaattttgtatttgttaactaacgttttcctcacctcttccctactcttcccagcctctaataaccactattctactctctacttctatgaactcaacatttttatctcacacatgagtgataacatgcggtatttatctttctgtgcctgacttattttacttaatataatgtcctccaggttcatccatattgcctcgaatgacaggatttcattctttttatgactaaataatattctttttgtgaatatgtatgtgtgtgtatatatatatatacacaacatatatatatacaacatatatatatacaacatatatatatacacacaccatatatatatatgaaacattttccttattccttaatcttttgctggatacttaggttgactacatattgtactactgtaaacatgggggtgcagatgtttctttgatatactgatttcctttggaaatagtagtggtagtgctagatcatatggtagttctattcatagatttttgaggaaacttcatactgtttttcataatggatgtactaatttatgttcccatttacagtgtatgagttttctttgtgttctcaccagcatttatttatttttatttgtttctatttgttacaacaaattcaaacttttggacaagagccattccaactgggatgagatatgtcttactgtggtttagatttgcattttcctggatgattagtgatgttggacctgtttttcagatacttgttggccatttgtgtgtcttcatttgagaaatgtctattcagatccttcaccaatttttaaatcaaattatttggggtttccttttgctcttgagttgggttcttttttattctgtatattaatcacttgtaggatgaatggcttggaaatgttttctgcctttctacaagttatctcttcactcagttgattgtttcctttaatatgcagaaacttttaagtttgatataatcatgtctatttttgcttttgttgtccgtggtttggagtattttttaattctctttttaaaaaaaatattctttctattttgattttgagtcttacccacaaaatctttgcccacactaattcctgaagtgtttcccttatgttttcttgtagcaattctatagtttcaggtcttacatttaagtctttaattcatcttgagttgatttttgtttatggtgggagatatgagtctagtttcaatcttctgtgtatggatattcaattttcccagcaccgttttttgaagaggctctcctttcagtgtatgttcctggcacctttgtcaaaaatcagttgactgtaaatatatggatttatttctgggttctctattctgttccattggtctaagtgtcttttttaaaccagttctatgctgttttggttactatagctttgtggtatattttgaagtcaggtagtttgatgactctaggtttgttctttttgctcagaattgctttggttcttgggggtcttctgtggttccatataaattttagaattgctttctctgtttctgtgaagagtgtcattggtattttgatagggattgcttcgaatctgtagattgctttgtgtaatataatcactttaacattatgaattctgacattagaaagcacacttcacctctctaatgtgacctttctcacaggtgtgcctccttcagcttcccatgtggcacccacagaaacattcacctatgaatggactgtccccaaagaagtaggacccactaatgcagatcctgtatgtctagctaagatgtattattctgctgtggatcccactaaagatatattcactgggcttattgggccaatgaaaatatgcaagaaaggaagtttacatgcaaattggagacagaaagatgtagacaaggagttctatttgtttcctatagtatttaatgagaatgagggtttactcctggaagataatatcagaatgtttacaactgcacctgatcaggtggataaggcagatgaagactttcaggaatctaataaaatgcactggacttttaatgttgaatgccttacagctagctgatcattacacaggcggcatgaagcaaaaatatactgtgaaccaatgcaggtggcagtctgaggattccaccttctacctgggagagaggacatactatatcgcagcagtggaagtggaatgggattattccccacaaagggagtgggaaaaggagctgcatcatttacaagagcagaatgtttcaaatgcatttttagataagggagagttttacataggctcaaagtacaagaaagttgtgtatcggcagtatactgattgcacgttccgtattccagtggagagaaaagctgaagaagaacatctgggaattctaggtctacaacttcatgcagatgttggagacaaagtcaaaattatctttaaaaacatgaccacaaggccctactcaatacatgcccatggggtacaaacggagagttctacatttattccagcattaccaggtgaaactctcacttacctatggaaaatcccagaaagatctggagctggaacagaggattctgcttgtattccatgggcttactattcaactgtggatcaagttaaggatctctacagtggattaattggccccctgattgtttgtcgaagacattacttgaaagtattcaatcccagaaagaaactggaatttacccttctgtttctagtttttgatgagaatgaatcttggtatttagatgacaacatcaaaacaaactctgatcaccccaagaaagtaaacaaagatgatgaggaattcatagaaagcaataaaatgcatgctgttaatggaagaatgtttggaaacccacaaggcctcacaatgcacatgggagatgaagccaatgggcgatgaaatagacttacacactgtacattttcacggccatagcttctaatacaagcacaggggtgtttatagttctgatgtctttgacattttccctggaacataccaaaccctagaaatgtttccaagaacacctggaatttggttactccactgccatgtgactgaccacattcatgctggaatggaaaccacttacattgttctacaaaatgaagacaccaagtctggctgaatgaaatacattggtgataagtggaaaaaagagaaaaaccaatgattcataacaatgtatgtgaaagtgtaaaatagaatgttactttggaatgactataaacattgaaagaagactggaaacatacaactttgtgcatttgtgggggaaaactattaattttttgcaaatggaaacatcaacagactatataatgatacatgactgacacttgtacactaggtaataaaattgattcctacagtctaatcatatcaccactattagggttttataaaactgcatttaaaaaaagatctatgaccagatattctcctgtgtgctcctcaaaggaacactattaaggttcattgaaatgttttcaatcattgccttcccattgatccttctaacatgctgttgacatcacacctaatattcagagggaatgggcaaggtatgagggaaggaaataaaacataaaataaataaaatagaatgacacaaatctgagttttgtgaacccctgaagggatggtctaaaggacgttatctggaactggagaaaagcagagttgagatacaattctatagattaaatcctggtaaggataaacattgccattagaagaaaagcttcaaaatagacctgtggcagatgtcacataagtagaatttctgccaagccttaactgcattcagaggataatatcaatgaactaaacttgaactaaaaattttttaaacaaaaagttataaatgaagacacatggttgtgaatacaatgacatatttctttattttcacatacactctagctgaaagagcaagagtacacatcaacaaaaaaatgggaacaaggctttggctgaaaaaaacatgcatttgacaaatcatgttaatagctagacaagaagaaagttagctttgtaaactacttcatttgattcagagaaatagagcatgagttttcttaaagtaaaaagaaaaggaacaaagaaaatgaggtttgaaattttttaccatggcaaaatattaacatctttctcaaaaacatagagaaatctggaaaaatcaagaagataaaattctggaccagttagtgacattctttcaagcatacttgtaaaatgtttccttagagtgttcttgggatgaaaatgattgtcatgtctccaacaacagtgaactgatgttgttccttggaataaaagtcaatccccaccttaaaaaaaacaaaacaacaacaacaacaacaaaaatatgaattcttccaatccatgaacatgagatgtctttccatttttgtgtttgccctctttaatttcttttagcagtattttgtaggtatcattgtggaaatctttcacctttttggataaatttatttttagctttaaaaatcttttgtagctactgtaaatgggataattttttcttgatgaattatttattactggtttatagaatcactactgatttttgtttggttgattttgtatcctgcaactttattgaatttgttaattagttcaaacaggttttttggcggaatctttagttttttgtttttttttttaaatatataagataatgtcatctgcaaatagggacaatttgacttcttgtttcttaatttcattccttactatttctttgtcttgcctaattactctcttaggaactccagtactgacatggtttggctctgtgtccccacccaaatctcatgttgaattgtaatctccaatgttgggggagggacctggtgggaggtgattggattatgggtgcagatttaccccctactgttcttgtgatagtgagttcttatgagatctggttgtttaaaaatgcacagcacttcccccttctctctcctgctgaccatgtgaagatgtgccttgcttcccctttatcttcttccatgattgtaagtttactgaggcctctccagccatgcctcatgtacagcctgtggaaccatgagtcaattaaacctcttttcttcataaactacccagtctcaggcagttctttatagcagtgtgagaatggagtaatacaagtattatactatgttgaataagagtggtaaaaaataggcatccttgtcttgctccagatttcagaggaaaagcatttttcttttccctgctgaaagcttttccatactcactatgattttactgtgggtttatcacatacggcctttactttgtttagtcatattcctttaatacctaatttgttgagagtttttatcatgacaaggtgtagaattttatcaaatccgttttctgcctctattgggatgatcatatgatttctacccttcattctgttgatatgatgtattatatatttacttattagcatatattgaaccatccttgaatccatggcctaaatccacttgatcatggtgtgtaatcattttgatatactgttggattccatttgctactatttttttaaggtttttgcatctgtgttcatcaaggttattcatttgtagtttttcttgttgttgttgtgtccttttgtggttttggtataagggaaatgctggccttgaagaatgagttaggaagaatttccttctttcttttcggaatggtttgagaaaagtggatgttagtttcttaaaagtttgatagaatttagcagtgaagttatgcagtcctgggcttttttgtttgtttattttgggagacttattactgtttcaatctcattactcattactgatctgtttaggttttctatttcttcctggttcaaccttgttaaattatatgtgtgcagaaatttatctgttttctctaggttttccaattttttggcatatagttgttcataataatctctaatgatcctttgcgttctgtgatattaatgtgtctcctttttcatttctaattttatgtattggaatcttctgtctctttttagtctaatgccatgttgattttgtttatcttttcaaacaactttttaaatttgctttttattctctattttgtttatttctgcgctaattttctttctttctttctactaattttgggtttaatttgttcttgcttttctagatccttgaggtgcattgtcagattgtttatttaaaatctttctaatttttgttgtaggtgttcattgctataaacttccctcttagtaatgcttttactatatttaataggttttggtatgcagtgtttctgttttcatttgtttcaagaaacttaaaagttttcttcttaatttctttattcacctttggtgactcaggagcacattgttacacttttatgtgtttgtacagtttccacagttcctcttgttattgattcatagttttattccattgtgatctgaaagatacttatgattttgatttttaaaaatttgttgagacttgttttatgtcctaacatatggtttatcctggagaatgttccatgtgctggaaagaagaatgtgtattctgcagctgttggatgacatgttttataaatgtctgttaggtccatttgattttgtagtgcagtttaagtctgatgtttcttcattgattttctgtctggatactctgtccagtgctgagagtggagcgttgagtccccaactattattgtactagggtctatctctccctttagttctactgatacttgctttatatatctggctgttccagtgttgggtgcatatacatttacatatgttatatcctcttactgaattaatccctttatcattatataatgaccttctttgttcctttttatattttttgacttgaagtctgtttcatctaatgtaagtatagttactcctgctcacttttgttttccatttgtatggaacatcttttcccatcccttaactttcagtctatgtgtgttgttgcaggtaagtgagttttttgtaggcagaatatagttgggtcttatgtttttatccattcagcctgtttaaatcttatagttgggaaaatttaaactgtttatattcaatattgttattgatggtgagtacttacttatctttttgcctccctccacctctgctttccattcttttgtctccctgtgtttagttctagatatgttctcctgatatattttacaaattaatactttttttttcagctttgtctacatgttgtcaaacctacccattagattatgtatttcagttttatttattgttacaatttcttgttggttctttttcaaatctactatgttactttttacacttttcatttatctcctgaaaatcttaaacttggcttttattttccagatcatgttaagtgtagttatttctatcttatattcccatggttgtcttttttgtattatatagatctcagctcagatatcaactcctcaggagagcttttcctcacaactcagtcaaagtagcctctactctatgacatcaaattttaaatttttctttatggcacttaccactgtaataaatacatgtttagatttgtttacttgcttattgtttttatgtacccaccctccatttttttagcctccatagaatgcaaatttccatgaaaacagcatctttgcctgtttattcattgctgtattttattgccaagagcagtccttggcaaataataagcatacataataagcaacaatacacattgttgaatgaatgaatgactgaatagctttatcatagcctttgtctgatttccctacacttcatctaatgttcacaagtcacaaactttgggagggtctcaaaaatcttctctgaccttgatgtcagaacttgtctccatcttgatcctacttctctcaacttccactttatttgcttgcttttatattgctttcctgttccacttatttttcagaagactttgtgttctttcttctaagaccactttaaggtaaatctctttaatagctgcattacatttctattatagttatatttccttttaaattttatcaggtagttaaaattatataaacccctaaaaattcttactgctatggctgccaagtttagaaaaaaattaaaagattatagttttaaaatcaatatttttttctatattttgagctctaattttattggccacacttttcatatcttctattataaattacaaagttcttagaggataatggaatatatattaaaatacaagccaaatcaaaaataaaaattcagctcttgactgagaaggtatctcaagagacttccaaagctccctatataaaatttcagggaatttcagaatattttatttgttgtcaggagtgagagtatgaggcaaggcaatcaattttttcattattcttaagatttttatgaagtgggatcaaataaatttatagaaaagttcctacaactttataaatgttagctttctcttgttttttctccaagtgcccatatacagaaaatcacattgtaaattgggattgtggagaaggtattgtgagataggtatagtgattagaggcagtaaatatggaaggttctagaatataatgagggttaaaaactaacttctctgtcaagaagacaactacccaaaggtgtcaggaaactaggctcagaaaatagctcattcttttgttagagccaggactgctttcctttaggaaaagctggcaaggaaattccatggcctagaagtctgaagattaaggtcagaaccttcaaagatggccaaagtccatcgtagaaggctactcttcagtctggggtatactcagaatggttagctatggtttcatctatctaggtcacagatgctttctggaaacagtaatatgccaagaaaggatatgtaaagttgctatataaaaacaaacaatggttaataatattttttgaaaactatgctggttttgtgctaaacactttaaatagtatccttttatttaattttcattatagtttcatgagctaggaactattaccatttccattttacagatgataaaactgaggctttcagaaaagattaaggtacttttctcaatttcagagctgaaactcaaacctaggttgcttcaaaaccaaaaatactcttaattactagtagtgatttatataaacatattatgcctgattatcatgtattgttcttgactgttcgttaatattgcatgttcttttaattgttgaggaagacttgactgagttgaactagccagagaagggactgatctgtgaattccttccttgctgctacatacctccctaactcctataggctcactttagaaaatagaagtcaagactcctacgaaggttcatttgagatgggaaggttggtgaatagacattttgtgcctggtaattaggaggaacaattggcaacatctgtagttcccccacaaaaggaaaattttgcctaatttttgagaggaagaaaggatattctctggcaccatatcttagagtctttgctggcattcctgtagtccaggataaaatgggaatgtcaaagaaatttcaggtgcggttttataggagggtacattaaagaaaaagcagagctgaaagtcaaggaaataattccaaacagaaggcactgggttagtaaaagacttaggcaacttagctgtgcaggggatgccatgcaactgaatcacaaagggtgacacactaggtgaccctcagaaaagctgatcgtgtcactgtggggagaccatgaggtttttgttactgtagttgcttgtttcagaatgcaaaagttttgcttcctttctctttcttatacttgtaagaagggagttagtgctaatatattaaaataatctggtggcaagatttctcaggtggtttggtgcgtatttggacctcagatttttttctatgtgcatctctgtcatgagaattatagctgattcaagtcacatgtacaactctaataaagacatgcagttaatgggttttctgtttttgtgtagtagatatattttaatttttttcattaatggaagaagtatgatgggtgaaaacatcagacagagtctggaatc

SEQ ID NO: 1194 - DNA, 69595 bp, Homo sapiens
aaagtcccccttcattagtaattgcagaaggtatacttgtagttacaagacaacaaggacttggaattttttaataggaaagaggagtttctttgcaaaagaatttgggacttgactgagtcatgaacctattctctccctctatttgaatttatttccattaaagtagtactaaccattggttaccgagaattaaatattacaaaaagcttatagcaagaagctatcttctatcccacttcccctcatcctcaatcccgatctccatatataaccacttttaactcatctattttattgatttgtctatttttggcatcatttttcttcatcttctagatacagttatattaatgtatctattgtgtattgatccacatctggaatcaggggattaggtctacaggtatcttttacatgtaatgttactacacctttatttcttccttcatcaactgcagtctcttttgactccccacttcgtaagatgacagtgtcagcctttgtaatccaccttcagctgtcctttcctctcccccctcacaaactctgaagtttttacttttataacacttacagcttttatatcctattcagttataaccataattaaatatttgttttgtgtcttgggtaactctaaacttctaaaaatatatattactaataaataaatattcacatggagtcaattaatctatgattatattttctttcttatatgccatttttgttcccttggagtttctaataacctttcctttgttcttgtgccttagttttatggtagcctcattttatttcaaactgtataatttttttctgtcaaatgtacttttccttgagagacttccctctaagaccctccatcctctgccccactctatgttgactgctatctaggtttgctagatactgtcagccaaggacattccctttgttgctctcttaaattggacccactgtttcctgtatcctgtattttcctttcttggcttgctctcttagtttttcaggagtctcgagaaatcatcctagtctgggtatgtggtagttaaattgtttgatcccttgcatatctgaaaatttctgtattcttgtctcacacttggttaatagttgtttagtaaaaagttacacattccaagatatatttccataggaaaaagccccaagagtctgattatcattacattgtcttcttcttgtggctccctttgttacttgccctctcattcttctatttaggggtaacctacgtgttgacttctgtttgttcactcttagttccttcaccagggagctgtctcagcccagtgcttacttttaaagaagaaattacaccactaagaattcaactgatttgcaactaggctgcttatagtctattctgtctttaaagtactttaaaagtcagattcaggccaatggtattatgtttagctgttcatgaactagtagtttttcttatatagggtcttggagaaattgtggaattttggaaaaaaaaacacaattttccctatgtaatgggagttctagaagcatgctagataaaatgtgctagaaaccctcaaagaatggttgtagattatcatagagttcagatatacagctccatccgtctcacagttggtagtaaagggcagatggcccggtgcagtggctcacacctgtaatcccagcagtatgggaggccaaggtgggcagattgattgggctcagtagtttgaaactggcctgggcaacatagtgagacctcatctctacaaaaaaataaaaattagccaggcacagtggcacgtgcctctggtcccagaggattgcctgagcccggaatgtgggaggttgcagtgagctgagattgcaccactgcactccagcctgggctgcagagtgattctgtctcaaaaaaaaaaaaaaaaaaggaaaggcagatgaaggtttcaaagaaagagacagcttagagaattgaaaaggagagtttagaagtgctggcacaacttaactggttcagcagttaccagctatatacaaggcacttagtttctttgggcctcaatttctgccttcatttatttaatccacaaataagcaatgaggaccatctgtgtctcaggcactcagaactggtgattcagtgatgagcaaaacaggtggaaatctctgccctcatagagtttatgttttagtcaggaatgatgtaagaaacaaataagcaaaatagggcgtgaggcggtgattagtgttaaggggaaaaataaagcagagagaaggggcagggtgtattgtgacattcagctgacctgactgatgccacagagtgtctcttgtgggctttataacttggtgatgtgtatgtcaaaattcagtgattataattcttattctaacagttttctctaaaattcccgtgtacttttaaagttaatttgaactctttcttatgtggctatagtcataccgtttatcagtaatgtttaaagctacccatctacctatgacttttgtttcattttgttttatgtctacagtgtttatcttttgaagtagccttttatcatcatatgaagtccagtttgccccaatatactgattttttggtcatatttcccacagaatgcaaagtattaacatagtcttgatttgtttttaagttcctaaaacaaaaacactacttttaaatttctgtactcataaaatgctaatagaataacaacatcaaccattcactgggagccaagcatagtatcaggagctcatcattttctacaacttgcaaggaagttattaccctcatactgttaataaaatttatggttcaggaagaggttaaatcatttgtcaaaggtcactcaaccagtaaatataaaatgaggtctccttggaggttgctttcggctctattgtattattattctatatatttagtgtgaaatttatcagggtatggtgttcaatttatagttcttaaaaactgagttgcctaaagacggctgctctgaacactacatgcattgtcctctcctcccatttgtttgcatatttttttttcttttaagagacaggtcctgctctgtcacccaagctggagtgtactggtgtgatcatagctcactgcaggctcgaactcctgtgctcaagtgatcctcctacttcagcttcccaagtagttggggctacaggcgtgtgccactacccctggctaattaaaaaaattttttttttttgtttggagaccgggtctcactttgtcacccaggctggtcttgaactcctggcttcaagcaatcctcccacctcagcctcccaaagtgctgggattacatgtgtaagccaccccacctagcccatagtgattcttgtattattattattattattgttattattattatttttgagacagagtcttgctctgtcacccaggctggagtgcagtggcgtgatctcggctcactgcaacctccgcctcccaggttcaagtgattttccttcctcagcctcccgagtggctgggattacaggcacctgccaccatgcctggctaattttttttgtatttttagtagagacggggtttcgccatgttagccaggctggtcttgaactcctgacctcagatgatctgcccacttggcctcccaaagtgctgggattacaggcatgagccaccacgcccggcccatagtgattcttttaacaaatatttaccattcattttcttgcatctatgctgttcccaaggatatagatgtgtacaaagtgtggtccctgccttcatgtttggtgattaaattaaatgtttatatatttaaagctccatggctggcatgtagaagctttaaatacagtttagctattatgattagtgttaccattatgatatgactagcaacaatgataaaatgagggggtaggggttctttagtaaagaacctactttagatcctacttccatttttctttgctaatttaactagtgaagctctggaaaatttcagtcacttctaatgacaatgaacaaaatgggttaatgtcctataatttatggtgaatgcatttggactgtggctcttgaaatatggggatgtcaacaattttcagagaagcactttatgaattttaagggcaaagatcttgtctcatccctattgctttttacttactaactcatataatgtcaacatgagtgaaatggaagtaattttcaaagtcctgcctaaccaaacacacgtaggaacaaaggttcctcacaggtaaaacaaatagccatcatctctaattgtgtgcagcattgttgacatgtatcataaagtccaacggcagtgtggcaaagttccccttaagctgctcacatgtgcagctgaccaggacaaagatatggtctgccatagctttttatttggccataaacaattgacagtaaataagaccaactctaaccagatttgagtagtttataaacttactaattgtgtccttaatctctccttttcatacttttgctgtccttaatgaccctttaacccaatcaacttcattcattcatacattaaacaactagttatgtgtgtctgcagtggagtaggcactctcctaggtggcagcagtacaaaaaggaacaaaatcattcatatgtccctaataggtttagtggggaaagttaatgaaacatacaaataagtgtattattacaattgtgaaatattacactcgtgatgtaggagaattgtgaaaagtgctgtaaaggagaattgtgttgtactatgagtctctagtcagacaagtcttgtgctatgagagtctctagtcagagaagtcagagaaggtgattgtgaaaacgtgcaactgagttaagatctaaagcaagcttgtctaacccgtggcccgcgggccacatgcggcccaggacggctttgaatgtggcccaactcaaattcataaatgtttctaaaatattatgagatgtttttgttatttatttatttatttttaagctcatcagctatcattagtattagtgtatttcatgtgtggcccaagataattcttcttccaatgtggcccagggaagccaaagaattggacatccctgataaagaaaaaattatgcagaggaagaggaaaggaatgaccatgagcagagacttcccgtaactcttcctccttgggcattctggtctcactttctaacccaagcagaacagagaagatccatgtcatttatactgtttgtcagcatcaagcctttctcttctcctgttccatccactgaaaatctcttctttctccatcaattaggtaatgcctcctatttcctaagcctggctatcaaaacagggattcattatcctgttttgttgtgtcctgtcctggtacaagggcacatagtaccttctctccaggaaccgttcatgtctcctttgcctctgctttcatgccaaggcatatattaaggtctcttgaacccctgctggaaatgcagcttctctctctgctggcaggtgtctagaaaagacacagccctcttctttccttcactagtgatgtggaaaaactgatatactctatctgtagacctgccttgactcatctgaaaagtgggcctcgtcattcttagctcctaaagttgccatcactgttatctacctaatataggatgccttatccatattgtttacatagaaaattttagccgaaccttcaaacttccaaacacttaagattttacattttaattgaatgtcattttaattgaatgttaaaattttacattttaattgaattctaataatttgaaactcttgtccttccttcttattctttccttatgaagcttttgatggcatattaaaaggcaatggcttgataatctttttatgttaatgccagtagagaatccttcttatatttcttgacattgagcttaactttgggatttaaggggccagcagtaagaggttgtgggatctccatgaaatatctagagatgagataacatgctggccatggaaacttcccctcaatttctagtgaaattataattgttttgagaaatatgactttgttaggaagttactgcaaaattaaatagtagctttgaaattggcagttattcatataaataaattccttcaggaagagctggattcagaagcagtttggcagttgtattaaacagcggttttaaggatgccacagatttctttaaaaaaaggcattgataagaattagcagattgaaccataaattgaacctccttccatacgttggccatacatatgctaattcaaaaatgtaaaatcgttattattccctcattaatttgattcgattacctttacaaaatagtttacagaacctgacatgtatattatatactatttgattataataaatgtgaatatttactcttcttaaggaagttaaagattcactcttcttaaggaagttaagtagttcaaacatatttatacatcttataggcaaataatcaaatagtttattccaaaatggtataaccatgatttagtttaggaagacagtcttccagataaagatggacatttgagaatttttttaatacttaaaaaggttttatctggccaggtgcagtggctcacgcctgtaatccaagcactttgggaggctgaggtggtggggatcacctgaggtcagaagtttgagaccagccttaccaacatggtgaaaccccatctctactaaaaatacaaaattagctgggtgtggtgatgcataactgtaatcccagctacttgggaggctgaggcaagagaatcacttgaacctgggaggtggaggttgcagtgagccgagatcatgccattgcacaccagcctgggtaataagagcaaaactctgtctcaaataaaaggccagggagtgggggagtttatctaagttagtcaaaaccaagtaattaaaatatataataagtagcatagagttttctagtgataattaatagctacaagcatggaataattaaatattaagagaggctgtctggtccaagttctaggcctacatatgatatgcactacattgaactgaatataggggctagtgagaatgagcaggctagaataaagaaagcatgcagctcattagaaggaaataaataaagctgggcaaattagaacagattaagctcaaaagatacttgattttgaaaataaaaactgatgtggagccataatgactattccatagtttgagtctttacagagatgatctaagcaggcatcattcaactaatatttattgagcaactattatattccagatattgttctttgaatgctagatgattcacacacagaccctgtcattggaaagtttcctatttaatagtagaggtaaaatatacatgtgaatcatagaatcaacataaatgcccatcagtgatatgctggataaagaaaatgtggtacatatataccatggaatactatgcagtcataaaaaatgagattatgggccaggcacagtggctcatgcctgtaatcccagcactttgggagtccaaggtgggtggatcacgaggtcagaagttcaagaccagcctggccaagatggtgaaaccccgtctctattaaaaatacaaaaaattagttgggcacagtggcaggcgcatgtaatcccagctactcgggaggctgaggcgggagaatcgcttgaactcagagggtggaggttgtagtgagctgagatcgtgccactgcactccagcctgggtgacaaagtgagactccatctcaaaaaaaataaatagaaaaataaaaatgagattatgtcctttccagggacatggatggagctgaaggccattattcttagcaaactaatgcaggaatggaaaaccaaataccacatgttgtcacttataagtggcagctaaatgataagaacgcatggacacatagaggggaataacacacactggggcctatcagagagtggaagctgggaggagagagaggagcaggaaaaatacctaatggctactaggtttggtacctgggtgacgaaatagtctgtgcaacaaacccccatgacacaagtttacctatgtaacaaacctgaacatgtatgtacccctgaacttaaaagtgaaaaaaataaaaaatatatatacacaagtcattataatataaataataataattgataatagaaagtacaccgtgctatgcaaatgcaaaaggaggatgccttcatggggaagatggtaaatctcaaggggaagcattaagcacgaaaatctgttataattattggagaaccaagatattgttagtatttaatgaaaacagaatcctgaaacacatcattactgcagaaacaataaagaatttttatccagcaaaattaacagtccttctgtggccatttttctcattccatgaaaatgtcattcagaagtggctgtgacctgggacctcaaagccgtgatcactctgcatgtacctgtgctccagacccagctctgcggctgctctgcatgcacttgcacttctgacagtggcatctctgtggcccaaacatgcccatgtgctggacctaccaccaaggggcatccccttggccacaactacccctgatagaaggaaaagagatcagcagcactgcagcaccttttactgccaaggaccccaatatatgcaaatcaatcaatgtgatataacacattaacaaaacgaaagaaaaaaacccagatcatcacaatagatgcagagaaagcatttgacaaagttcagcatccattcatgattaaagctctcaacaaaataggtatagaagcaatttaccttaacacaatataggctatatatgagactcccacaactaacatcatcatcagtggggaaaagctgcaagctttttctgtaatatctggtacaaggaaagaatacttactttctctacttttcaacatagtactggaagtcctagtcaacaattaaataaggaaaaagaaaggcaaccaaatcagaaaataaataatgttatctctgtttgcaaatgacatgatcatgtacatagaaaagtctaaagactcaataaaaaaccgttagaactaataaatgaattcagtcaagttgcaggttataaaatcaacatactaaaaatcaatcatatttctatatacaaggaataaagtatctgaaaagggaattaaaaaatcaatccatttacaatagcaataaaaataataaagtactcacaaacaaccaaacaggtcaaagatttatacatgaaaaattataagacattaataaaggaagttgaaaaagatacatgtaaatggaaagacatcccttcatagataggaagaattaatattattaaaatgtccatattactggaagtgatctacatattcaatgcaattcctatcaaaatcctaatggtattcttcacaaaaatagaaaaaacaattttaaaatgcatatggaactacaaagcaacctgaatagccaaaacaatattgagcaaagacatgaaagctagaggcattatacctcctgatttcaaaatatattacaaagccacagtaatcaaaacagtgtgtcttaggcataaaaacagacacatagaccaatgggacagaatagagagcccagaaataaatccacgtatgtatgatcaactaatgtttgaaagggtgcgaagagcacacattggggaaaggatagtgtcttcaataaatgttgggaaaattagatatccatatggaaaataattaaattggacccttatctcatatggtatacaaaaatcaacttaaaatggattaaagactttaatgtaacacttgaaactgtgaaactactaaaaggaaacatagggaaaaacttcttgacattggtctggacaatgattttttggatatggtgccaaaaacaaaagcaacaatagcaaaaatggacaaatggataatttaaaactaaaaacctgcacagcaaaggaaacaatcatcagaataaaaaggcattctacagaatgggagaaaatatttgcaaagcatatatatgatgtggttaaaatacaaaatatataaggaactcgtgcaactcaatagcaagaaacaaacaaacaaataacctgatttaaaaatgggtaaaggggccaataggaggatcatttgagaccaggagttcaagaccaacctccacaacattgcgagacttgtctcaaaaaaaaaaaaaaaaaaaaaaggtaaaggacctgaatagccatttttcaaaagaagacatgtaaatagccaataggtatatgaaaaggtactcaacttcactaatcatcaatgaaacacaaagcaaaacaaaagtgaagtattattttacacatgttagaatggctgttatcagaaagacaaaaagtaagtattcacaaggatgtggagaaaaggaaatgttcgtacattgttggtaggaatgtaagttggtacagtcattatggaaagagtatgaagattcctcaaaaaattaatagtagtatgatccagcaatcctactctgggtatatatccaaagcaaatgaaatcagtatgttgaagaggtatccgcactcacatgttcattgcagcgttattcacaatagccaagatatgggaacaaccaaaatgtccatcaatggacaaatgaataaagaaaatgtttgtgtatgtgtgtgtgtgtatatatatatgtatgtatgcacatatgtcatgtgatgcctaacagcatttcagttaacagtgaaccacatatatgacagtggtcccataagattatacggtattcttactgtaccttttctatgtttagatactttttgatacacaaatacttaccattatgctacaattgcctttagtattcagtacagtaacatgctgtattgcataggtttttagcctaagagcaatagactataccacatagcatagtaggcttatagcaggtgcatagtaggcttataccatctaggttagtgtaagtactatgatgttcacacaatgacaaaattgcctaacgatgcatttcttagaatgtgtccccatagtaaagtgacacatgactgtatatgcattggaatattacttagatttagaaaagaaaattctatcatttgcagcaacatggatgagcctggcagacattatactaagtgaaataaaccagatgcagaaagacaaatactacatgatttcatttatacatggaatataaaaatgtcagactcagaatcagagagtagaatggtggctacaagggtctagggagagggagataaggggagatgtaggtcaaagggcacaaagtttcagttatgtaagataaataagttttggagagctaatgcacaatgatgtgactatagttaatattgtatagtatacttgaaatttgctcaaggggtagatctgaagtgttctgatcatacatacgcacacagagaagaagttacaagaaacagtttgagataaatgggtggagaaagctgttaaataataggatgagattttcttttgcaggccatctattttattcagaggttgaaaacacatgcctccaggcaggtaacatatgagaaaaagggactaggaaggaactgtggctaactggtagctcatacatgcatagtcagtagtgacagtccagccagtccccagcactggtggatttttgtcacagcaggattgtgtatttaaaggttctgtggaaagaaatactattttttaaaatactgtgtctattagtcataccagtttctgagctaagagtttaggcttaattcagcaaatgggatgcattgttctctatgtactaaagtatgcaggaatatttctttaaacttttccagtctaaatgtttcttaaatttttgcccaaacatctgggaagatctcttagtttctatcagatatctccctttttgcaatttgtaaatcaaagcgattttctaaattcagtcaagtaggagaggaaaatagaattgctgttggtgactgtggctcctaactatggttagtgagttctgagggtgaaacaaagctgaccctggagttgttccttggcacttccagcaaggctgcttcaggttccttgcctgtggttgaccctgcacatggagatcctgccaatcccactcatatttacaggtatcactcctgcaggtaagcctaacatacatgtctcttcaccgtgagccaggtaatgaatatatatgtgtaatttaatcatggtttataacctatgcctaataaaagagtgcttgtgaatttagaaatgtttgaaaaaatgagttagaaattaagaaaataagcaggttttaaatttgaaaactagtaaagtgtcaatatgtatgtatgtgtgtatgtgtgtgtgtatcaggtgtttactgcatttctagcaccaggtatggctaacattttaccccacagtattttcctgggcctaaaagattaccatttaataatatctgctatttgcctggcactttattaaactgtctctaatccttaagacaaccctaagaagtaaatgctagtatccccatttttataaagaaatagaggcttaggaatttgagtgacttgcccaagatcacatattcagtacattgcatagcaaacagcctgtgctttgcctactgcacaatacagactcaagaatgtgcacatgataggacaaggatatttaaaatgagaatttcatgtattgtattccatttcattttgtgagcatgtgtatgtgtgtgagcatatgtgtctgtatacatatatatatatatttgtatcatgtgcatatgtatgatcattctgagcaatagtaaattccttttaaagatgcgcagtgtattactgaagacagtggagggtaggagttaggaatataggccgtagaatgaacctaggtcatttcaccataaatcatagcctggacttcagatcccttttctgtaagatcagggttattgcgaggtccacattagacaaaattcagcttggcacagtgtttcatatatttggcacttaatttaaatttaatttaagtattggtcagtattgtcattaataatctgtatgttttctccttaaatttcttgtcttctctcttacttattaaaaatatcactatacattgaacctagattctataatccaaaggcatcaatggacattgagatgcttgcctcatatccaagatgtaagagaaagtgcacatgcctattttaaggcaggccacagataggctataactttcaggtatgagtgggtcaatacaatcaaacaaatcagataaaatttagtaagagcatagacagacagtatttggagcaagtatacaaagacatagaaaagactatctacagggaggttggaaacatttaggatatactgggtagagaaattataggttcatcttttgggcagctgtttagatacaatctagtaggattgaataaagggaatttaagtcacaatacatccattctttacatcttttgctatgtaatgctacaggcaggcagtaatgagtactaggttcattgcaatgagatagaactgaaaaaggtacatctaaaaggatttttaagactaaaacttggtggcagattgaatttaggtggagggagagaaagatgttctaggtagctccaatgtttggccgccataggtttatgagaagtgggagaagcagatctagtttgtccagggggcattgtccagttttatactttgaatttagagtgatccactggagttatcttagaagccgaaactaacaagatccacttttttttttttttttttttttttacagggataactgtaaattcctacatttaggttaagaaatgaattcaattgcacaagtccaggatgtgggatatctgcttgacagttagcttaggggtttttattggccacagacaaaactaattatgcaccaacaatgtgccttgttgctgaaagagtacatgccatgttaggctgcataatagaagtgttgtcatccgccagagggagacccgtggtcccactaacatatgtgctatgagagctgatttcctgtctcaccataggctccatcttttcagagaggggtgctcacaaaaattagagagtggtcagtatggtcaggggtctggaaattatgtcctgagggaaatagttaagggaaaatggaaaaaatttagagggaatatgatagcaatcttcaaaaatttgaaagattatgtgagagagaaggagtgcaaatatttattatgattgctgtgagaagaattgggtagaaatttcagagagcctaaatactaaaaaattaaatatagatagctagatcttcctaacaagataaaagtgctacccattactgggtgtgctcatggggaaggtatataattgcccacctgcattctgtatgttggtctaggtgacttgtaaaatttccttctaggccgggtgcggtggctcatgcctgtaatcccagcactttgggaggctgaggcaggcggatcacttgaaaccaggagttcgagaccagcctggccaacatggcaaaaatcccatctctactaaaaatgcaaaaaaaaaaaaaaaaaaaaaaaaaaaaaaaaaaaaaaaaaaagccaggcgtggtggcacatacctactacttgggaagctgaatgagaatcacttcaacccaggaggcagaggttgcagtgagccgagatcatgccaatgcacgccagcctgggtgacagagtgagactgtctcaaaaggaaaaaaaaattcttctaattgtaagttgctataattccgtggctcatgggtctatgagtagcaatggtgtctttcaatctatagcaatcagtagcaatggtgtctttccatctataaccatatcaatttccaagggagagagaataccaatagaacttcattctacatttaattactgaagagatgcaagctttaaagcttatcaaatagttgtctgtcatatgactaaagccttccttcaggaactacacataaccgtagagaatgttactaatgaaacactgcctacattctttctgtatatctgctatttctgcagttctttgttagtaaaacaccatttgaaacaatgttgtcaaagcattccaaatatcttacatcaagtgtcatcttctcagagagtacttctctaatgactcaatctagtcctgagttactttccattgcattatcttgttgtctttttttcatatttaagactaactactaacacactattcatttgtttacttatttgttgtctgactcacttcccaacatagaagcattgtagagagggatcttgtgtgtcttgttcactcttcctctagcattcagaaatagtaccatcatagacatatcttaaacataattgaattaatgaaacatctaggttggggcttgaggtatttctcaaaggtaactctatccttgctacagtgtttctggacctttctgtataatttaagtaatctacactgaagctctgatgtatttgccatggtgacagagtataaatgctactacctagtctttaagagacatttatgaatttaaaggcaatcagtgaatcttcctttggttatcctatgctatgaagaatattcccagtcgcactcacttcatcttagttttgactttgaaatcctttacaagttgaggtttttatgtgaactctcttcctcttctccaagctacattcttggttgcagagctcagaatttcacatggtagcttcttccagtcaaaggaccatgtggttatccagataaaatgtcttttcctaggtcatctatccattttataatatcttgggagctaacttggatgagataatcaactgtggttgtcgttcaccctactacattcccctagattgcctttcaaagtgactttttccttttcctcaaacctcctaatctcctcctctcagcagatgactttgtttcatatttccgtgagaaaacagacatcatccttcaggaactctctcatcttttcatcacgaattcatctacttatctgatcctcactcaccctttcctaccttccttcctactacccttgatgaagagccctttcacttatctaaggccagcacccacttgtactttgtacctgtctcatcttctaaaggattttgattctgtgagtgtccccatatttaaggcatgagtttctaatccctacagggttatttccatcagcacataaataagctatactatcatttatcttgggggtgggggggaactccagcttcttcttcattttctagtttcccttcatagcaaaagttcttacaagaattgtctattagttgttgtctttgctttctcacattttctgcacagcccacttcaattagactttcttccccaacacttcacccctattttcaaggtcactaatcactttccaattgctaaatccagtggttattttgatgctttaattttgtttagccttcccctgggatatgtcccaaattttcctttttaaaatactttttgtttcttttgcttttgccttggattctgttacactatatatctgggaaatcctgaaacatagatttttgtaatattgaggcatttctctcagaagaaaccttcccaggagtgagggaatctggacagggcagggaaagaacctggataaagaggtggttccaggagaaatgtagtctcagcccaatcccttcagagctttggggcatgccctgcagcacagaggcaaaggggttgggctgttatgtcctggcatctgccatggtgtagcagctgtctggaaggatggagcagaggcacaaccttccaggtaaagcccttccttgcagttaagggaaattcttccaagaagggcgcaggagaaagtcctcacgggataaattcatggtagctgcggatggagcacgactcagctgtgggatgtggtgtaccagatgctttaagtggcctatctttgccttctacttcagccactcctcagtcagttcctctgctgggcttgcattctcatctcttaaaattccacatgatgccttttacttactgaaagctcacaaatttattctgtgctcttgattactccggagaaccctagaattacatttacagctcctacttgacattttcatttaaagatctaaaaggcttcttaattttaacagggataaaactaaactcttgattccttgtccctcctccaaacctgcccttgtcccagtttccccatctcaggtgctcaagttccaaagttaggtgctactcatgattcttctatttatcttacatcatacaacattctggctcttcatccaaagcatatcccaaacccatccacgtctctccaggtccaccatccactacctagctaaagccattgcctcttgcctgcaccactgcagtattgcctctgtgttctctttgtgtttcacttcttgctacccctgcagattctgctgtacagatgccaggatgatcctgttaaaacacatgtcaaataatgttacacatatgcttaaaaccctacagtcatttctcactgaacttagagtaaaatcccaaccccttaccctagtttatgaaaccatatgtaatctggcccaagtatacctttccaacctctttttcgctgagtgttcctctacctgcagtgctcagccacattagctgcatctcctggggctcctcaaccacaccaagaatgtgcctccattggggtctttattttgacaatttcttcttccttattgtcactcagatctcagtctatatatcaacttctaagacaggttctcctgatcaacaaatcactttctcctcactctttaaattgtctctagaacacttaatactgtctgttatttttgtattaatttgtttagccatttagtcattggatggttgctttcttactgtgtaagtgccttgagggcaaagatgttacatgtcttatgcatgcaatgaatattttttaatgagtgaataaatgaatggtgacccacctgctttaagagatatgtattcacttagaatatgtgcagtttagactgcatttttaagctgtttgtttatggatatatttctaagcatcaaaaaacccacaaaaaaacaaaaactaaaccaaaactgaaacccaccctgctttacagtcaagattgattataatctgtgatttccctttgacatatgatgaaatctagttactatgtatcttcatatatctgggccagacccttatattctgtaaaacacaatgacaaaaatatatctaactcttatgtaagaacttaccacataacatacaaaatgagcactgtacagtatatgccctcagaaatacacagaagagcattgatagtgtgggacattacaagctgtttcttgtttactttaaaaatacatgttaccatccctttttttaggtgataattcaccatgagtctcacacttctgcacattctgttaacagaggcactggctggctttgttttggaccaatttttccagtataattacatagcagacaagcttggaaattagaaatagtgtctccctctggaccgaagggcaggcatggttactgcccatcataaaagattcatcataaaagatttgcccatcaaaaaaaactcattgttcctgttcagtaacacagcctacttcacatctaggtatctctttgtgttctttgcattttcagtgcaaaaatagtaatattctggacacttctattgctctaagtagtaaacggtcccttgtatctttcccaggggtctcatgttttctaccagcattcatgaaactgtggcaggttcacttgttagcttgtaaactgggtaaaatcttggacctttcacaatgcctgacacattcttgcgtatctcgccagtcctcagggagattttcttgggctgtcagtactgctagactgctgtgcatgtttcactaaatttaggcaaaagaatgaaatctaccttgttttggaagagactgcaaatagtcactttgataggcaaataatggacccccaaagatgcccacacctaatcccccaatcctctgaatgtgttaggttatatgacaaagggaaattaagggtgcagccagaagtaaggtggatagtcagctaacctggagaatgggaggttaccctagattatccaggtggacccagtgtaattatgaggtttttaaatgtggaagagtcagcattagtgtgatatgatttgaaaaagacttaaccagccattgctggctttaaaggggaaagtggggcatataagccaaggaatggaggctgactctgaaagttaggaaaggcaggcaaacagatcatcccctggagtttccggaaaggaacaccagcttgattttagtcagtgagactgtttctgatttctgatctccagaaatataagataaatttgtgtcgttctaagccacaaagtttgtggtaattttttatagcagttataggaaaccaatacaattacagactctggataaaatagctacatgaatgtattttaacttcacatttacaatagaagaaggcctcaaacatggtagtagatgtattatactgttataaattaggataatggtaattcttagacaaaagcacatatgcaagtaaaacctttaccatgaattcttaggatgagaaatttcattttaatatcaatgtatatttctttgtgttaatttaaatcattgtcttacatccataacaagtactaagtgacatttaaatataaattgtgaatggcttcagttttcttcttaatttttttggttttatgtaaattcattagtttgttaaaacttccaagattccttttatttggcccttactattaaaattctaaagtatgcaattggtaattaaacctgaatagtaaattatgtttaggagtaaagtaaaagactctttgtattttggaaagtataattagattttacaacaaagaatattactatatttttgggaacaatctgtatcacttatttattggattacaacatcaaggaggaactttttaactcccgttatgtgcagttcttcctaggcctgaccaatctgttctctgtaggacagataactgtagggtagatcttttctacgctcattataccatttcaatagtttgttttctaaattttgtgatcccacagagtgacatcacccacagagcccacacagcctgcagtaccaggctgtgtacatgtaatagagtggtcttatggcctagctcatttgggagtagtatgtcaggaggacctcagatctttggctatgtttctgttttcagtaacttagctcctttgctgagtgtttaatagtttgattctataggtcacaaggttcagatactcttaaattgttcaaatgatttataaatggatcatcggttgtggttttacatatccttgggatggttagtaatataattttaatgaacttaagtgctctaattaaaaattaaattgtgctttaattaacataaagtgagcatgaagctcaaatgaactttgtttgtaaagataactttaggtataactgaaataattgtttaaaaatattttgaagttttcttaggttacatagatgtgagcaagggagcttaaattatttctttttttcatttgaagttggatgatatatgagtccattaaacctctatatgtttgcagttgacaacactaaatctgggaaacaaccttttagaagaagttccggaagagatgaaatatcttacatctctgaagaatctccatttatctggaaataggatctgtagatttgcacctggagcctgtggtaatttaatcaacaaggaacaacattatagcatcaaatttaatctctcatatttaataatatgagactgaaatgaaaaagaattttgcatgtttaatctttttttgttggagatatttacatactactcttgaaatataggaggagacaacacttttaaaaaagtattgtatcatatgtttatttacatgtagacctaagaaaataagtaagcatcagtgttaatgaattttcctctttgtagaatcagtataaagtcagattgtgaatctggggacccttttcctaagccagagataattctattgggaaatcaaatcaagtaaagctatactgtagctttgttcttttcactttttattctgtcttagatattaagtcacactttttgatcaagatgctaaacttaaatcaatttggggagaattttaaagaaaagatatgagatccaataagcatttttttctttctttttcccattaactaataatttctccattcaagatgatgctattcttatttaatattcctagagtgggcttaaggacaaatgtatgacaaagagatctacatggcttttatagctttatcaactaatgtaaggtacttcaccactttctgtgttggtccttagtagtaaaatgagagaaatattataaaatttataaatttctatgaacttttgaggcatgggtgctatatataatcattgtcatcttcacacagagtttattaatggcattactgcatgcagcaataaattaggggttatatttggcaaatagcacaagtagactctagtactgtctttttaaaggtactttaaaatcttaggtcatgtatcttggaacaatattcttttccaaaataatagatgtaacaaacaattattgaacttgaacaccttatatatgcaaagccacagaccagagttcagttacaatttaccttggaagaaaacagtttacactaaaaaagttaaggtcatgcaaatcaatagataataatattttatgacctatactgaggggacaaatttaagtgcaacctgatatacataaacaatattgaacatactaatttatactaattaaggctctataaggaattttgtatcatgttgcctttaaatttgaggtaagttaggtatatatatatctgtatctatatctgtttagatatattttatatatgtatataaaatttgtttggagtgctcttgaatgtctttagtttctatatttctttttaaaaataattatttttttaattgacagataacaattgtacatactcatggagtacatagtgatattttgatacctataatatatagtgatcagatcagggtaattggcatagccatcatctcaaacacttatcatttcttcgagttgggaacattcttgacttggggttattgaactttgaaaatcccatgtgattgacctaagttatgttctatgtcaggtcctgatgattcaaggtcagaagtagtttgatgtcagggagtttaatgctgcccagcatgggtagaataaccttgttgcattacatgaccctatttccctgaccagagcagattgatcagggctggagttgggtcccaagctaagcttgtcatattttctctttcttgggaattgtgatagagtctaaaacagtttaattggtttgagataattacatgacctgaggcagagattgcaaactggtggcccatgggctgaagctggttcataaataagttgattctattttttttgcctttaaaaatctttgaattaggtgcccatgttttcaaatcaggagagttcacaaagaagtctggatctctggctctttttaaaaatctgttttaaaaaagaaagatttagcaacactgcagttgcgttcccatatgacaattgccagagctggctgaatggtggtggccctgtctgacatggcatgggattatcattttgattcctgtggacatgtgagtttgaaagctctgtcttccctgtcaatgaacattcaaattcagaagttgtgatatggttatgagtacatagaaaaatagagcaaacatgttcaaaagagagaatggagggaggaaagagagagcgggtaagatattataaatacgaaaatgagagaagctgtaatgaagaactaaattatattttctgcagagatattcagacagtacattctcaggttctgggtgcttttagcttctgattccagtttttgatgagcctggttgcatcctcattccacaggcacagtgacttagatttgtaactttgtgataaattactcctttttgcttgagctagtttaagagggtttctgttaccaccaccaaaagagccttggccaaggcaagaaccagaaggaaaacaaaggtatgtagaaaagtagaaaagtgactaaaaattatctaacagatggctaaagtgactaaaattattttctaacagatggcttacaaaatttaatcctgcttaatctgaacaacaatcatcttacgcagcttcctcaagaagtcagcaggtaattttgtttatagcaagacttggttaacaatcgtgcccctcctctatccccaccctggtcatttgaaagcattatgcctagcataagtccctgtgagatttatacatagcaaagagggatctgaaggactgaggcaagccactaattttaagcagatgattccttaaacactttggagaaatgagaaacagcatgataatcttagtgtaaacattgggctttgaaacataaagttctaaaactgatggtctcattgatttcccaactctgaggttcttggagcttggttagccacagaattgggcacattaaatgttatttcgcatgtgtattgtaaaccattttgagcttgatggaaaaggtaatgtaaaaactaaggatttaaaactgcaatgtcattttcgtttttaaaaaccccacattttattgtcattaaccaaaaaaaaaaaaaaaaaaaaaaaaaaaaaggctgtttttccttatcctgcatatctgcacaggcagaatgcctttctggagccagctgagagccttgtccttctgtaggcaaaacacgctcttgggcttttcctctgacagatggagagagaactctgttcaggtttactttggagactccctttattgcctgttgagcagaaacagatgtgtcacagagcaagagcagcatccagggttttaaaagagaatacaaaactttgaacagtcctcaacacagtgctttctgcagcacctaacatctattccaatttacttgtctatacctctggccaatgtattattttttccaaatatatttttataaggaaagcaatattttaagtcagagcaactagaaaagaattgaatcaatctaatttctataaaagataaatatttgcagcaatgaaaatgccatgctaatagttgtctgcttgcttttttacaaattcagcttatcaatcgatgtatatattgatgatgatataattttaaaaatcccttgggagatctcatgaatgaggttcagggcatatctctgtgcaactagatttatgcctttggaccagtaatttaactactttgaactgctgccttctcatctctaaagaaagaattttgaatagatgaacctcaaagtttttgcagctataacacgttatgatttcacaatttcatacacttatctctgtttggaatacaaattacagtattcaaggaatcgtaaatctaagggaatatgttagaaagatgaaagaatgctttcactgaagaaagtaggattgcagagtgtataggtctattctgtcttatagttaactctggattgtctatattctggccatatcctactagatatcaattaattggtcatctctctaagtagaattccatttctgagcctgggaaagtttcttcactttcctatatcttaacatcttcacctgcaaaatgaggatgatgatagtattttcagaaaataaatcggattgttttgacagttaagcaaattcatacaatatatttagggttgagccttggacataaaaggtattagggttgagtaagtgctcaatggatgttagcttttattattattggttgttatttttattctagcttctttctgttccctttgttcactgatttccagagacaaaggaatgacttctcagtggatttgggcaaagcattgagcatatgtagtttggcattctcctcttgccctgccatgaagtaagcagcagcctcagcaggaaaggctgtgaatggggtggtatatttaatgcagaggagggctagcagggactcagagtgatcatgtcagctctgtgctgatgtttgatttccttctctctaaattccatatcttatttctcaatttatttagaacttaggagagggaaaaggagttttgtttttggctcatttaaactacagaatatcagttcatggacttggagtcaaatttgggcaggtaagagttttacacctaaacagctctgtcatggacagcgctgcacaggcacaggaagaggacagcatgggcatcctggtgacagaatgagtctggaagacagagagagagagcaagggactaagtcagcaggctcagttctttctccaaattcgtcagtcagtgaagttgttcttcaatctcctggggaagacagatgtcagggagaatctacaagtgtatctcctatagattttctttggaaaagtaggacatctccctgctttgtggaatcgggaacaatggcagatatttgtttctctccctgctctttactcacacaaatgaatgatggacaaatgaacaataggatctgagctcattttattgccttgaaagaacaaaaaagttaaaaccaactcccatgatatagtaaatcagagtagaatcaataaaaatgataataaaaatgattataaaaatgattaatgaagaaaattccccatccctttccccacaggacctgctccacacatttttactccatttcagtgctgagttgtccttctttgaccctttatactgcaaagaacttcacttcctattatcctgagaaatttgagctccctcaatttccttcttttcagcatctttctctccattgttctatttctttccttcctctcgctcttgcttccttgtcatctctctctgaagtcccgtgtcttttgcttttgcttcctgtgtaacacattgtaaattctcttctgtcttctccattctaccttagatcattttcaaaagtcgttactgtcctttacatagtcaaatataatggccttttttttctgctgaataaaaattacataaaactattcaatgcattttgtactattcaatgcattttgacaaatgtacgcacaccaataagatgtagaacattttcttcagcccagaaatttcctcatacacccttccagtgaattcttacctctcataagcaatcaatattctgatttctgtgttctttacaaattagttttaccaatcctagaactaaataaatggaatatggtatatacatttttgtgtctgtcttcttttgcttagcatattttttgagactcatataactgttgcatttattagtagttcattggtttgttttttgtttttgtttttgttttttattgagacagagtctggccctactcacccaggctggagtgcaatggcatgatctcggctcactgcaacctccgccttccaggttcaaatgattctcctgcctcagcctcccgagtagctggtattacaggtgcctgccaccacacccagttaattttcatatttttagtagagatggggtttcgccatgtctgccaggctggtctcgaactcctgacctcaagtgatctgcctgcctcggcctcccaaaatgttgggattgtaggcgtgagccaccatgcctggcagtttttgtttattctgagtagcatttcattgcgtgaatatgccctaaatcatttgtcttttctcctattgatgtacatttgggttatttccagtttagggctattatgaattaagctacaataaacattattgtacaaatctttttgtaaacatgtttaatttcattttcatttaaatttctaggagtaaaacagaaatttatttctcatagttctggaagttgggaagtgaagaccaaggtgctggcagatgtgatgtctggtgagggtctacttcctggttcttagagtggcacctttctcactgtgtcctcacatggtagaaggggcaaggagctctctggggccttttgtaaggacattaattacatttatgaggtttaccccatcatcatgacctaatcatctcccaaaggccccatctcataataccatcacattggagattagattttaacatatgaattttgaagagacacaaatattcagaccatagcactgtcatttctccaataccatatgatcttgattatcttgattgctgtagctgcattgtaagttttgaaatcaggtaaagtgagtcttttgattttattctttataatagtttggctattctaggtcctttcaatttccatataaattttaaaattgatttgtctttttttttttttgttttgtttaagatggggtctcactatgttttccaggctggtcttacactcctgggctcaagcaatccttccaccttggcctcccaaagttatgggtttacagccatgagccacagcacccagcccaagtcaagtcttatacaaaaaaagctgtcaaaatttgtatttgaatctattattgaatctatagatcaatattaaaaagttgatatcttagcaatattttgcttttctatacctgaatataatatatctctacttttatttaaagcccctttacattctctcattcataatttatagttttcagtgtagaggtccctcatgtcttttgttatatgtactcttaactatttcatgaaggtttttttatacattactataaatggaaatcttaaactttttattttccaattgtttgtggctacaatatggagatacaatagattttttaaatattgactttgtagtttgtgactcggcattatttctactagttttgtttgttagtttggattatctctctttaacatttaaacttttgaccatctctttaattttgaaattttcttttctcacaccttcagagattccttgctaatctggttcttcttctacttctgtgttcataactttgctgggtgcctttaatttttaatggtcagttgtttatatttctcaagaatctttctgttggcttcctctctcttctctctgcccattttcttttgttgtttttcctatcaatcccaggtattcatatggcttctactatgtacggagagatctgtagaatcctcaaaattccctttgctagcactgatgacttcctaacctccagtctcccattttcaactgcctaaaaatttagttccctcattcttacattacttcaatcttaacacacttcaaccttgagatcattacatgttttcactcttagctttgcaaacagacacacctgcattagaattttgacattgttacctactagataggtaacttggggaatttatttactgcctctaatgctttattttcctcacttttaaaataagagtagtaattccaacctcagagtcatgttgatgattattaaatttaatgcacaggcatgtagttgtgcttagtaatgttaattcccttctgcttccttattcataatatttttcttagcttactattccctcttattgccctattttataagttcttttattcagggccaaattcaaaatgtcagttctttagaaaaacttgcaatatgcttcaggaaccatatctgcaattacagactcaaatttccttaacctttttctccttagccaatggcatttgctgttctcagtttgtggctctatttaatatctcctaaaccagggcatccaaaagggcagaatttgtggctgattcatctttgaacttccacagcaattgagcagtactcatatctatttggtactaggtatatttatgtctatgtatgcttatgcctgttcctgtattgatctatatacataggtatgtccgtgttctccttgtcctctagctttctcttgggtatggccaatgtatatgtataaagaaaggaaatataattttctttttctgaaatctaggttttgattacctaacatacttttaacataagccatctgattacaaaagatctttaaaaattaaatttcagcaaaaactttttatactcatgatcacaatagttgtaaacacttgactgaagtaagctcagaagagctacaaaaaataaattgacacatggcttctgctaagttgggcctatatagtggactcttattcttgtgagtttcattcatatactttggtgtttttttttttttagattaaaaagtcttacttatatgagtataaattataaccaactagccagcattcctagagaactttgttttcttgagaatcttgttgaacttcaacttaactacaatcagctgatatgcatacctgaagagattaaattcttgaagaagcttcagaagcttttgctagccagaaacaacattggagttttgccggaggtaagcaaaacatggaaccacagtagtttgctgttggagaagaactcaacatgatgggaggtggttatagattagatttgggtatctgagtataagccaccacttgctttctctcagattaaatgtagtcagttcccaaatccctatgacagaagaaggctataatttgaattatcccacatagctagggctgccagatttagtaaatacaaatatagaatgctcactgaaatttgaattccagataagcaatgattaaattttttactataagtatgttgcaaatattgcatggaatagactaaaaaacctatttattgtttggtatttctttctttcttctttttgagacagagtcttgctctgttgcctaggctggagtgcagtggcacaatcttggctcactgcaacctccacatcccgggttcaggtgattctcctgcctcagcctcctgagtagctgggattacaggcagacaccaccatgcccggctgatttttataatttagtagagacggggcttcaccatgctggtcaggctggtctcaaactcctgatctcgtgatccgcccacctcggcctcccaaagtgctgggattataggcgtgagccaccgcacccagccttgatatttcaatttaagtgagcattatatattttatctggtaacgatgtatacagaacaaaatacaagttcattttggctttggaatatgtactggctctccttttttccttcatattcactttctgtcctgccttctgcttgggagactgacctgtgtgggcagcagtgaacttctttgtcctctggtttcctcttggatatggcagatgagaggcactagcaggaagtgacagggcaggaggatagcaagtagttgatggtattcataattatggagactgagaagtcctacagcaggctatctgcaagctgaagaccctggagtgctggtaatgtggctgagtccaactctgaaagcctcagaaccagggaagcaaacggtgtaattctcagttggaggtcaaaggcctgattactgggaggttgtggtggtggctggaggggaggggtactggtgtaaatcttagagtctaaaggctggagagcccagcgttctgaggtccaagggcagaagaagaagtgtcctagctccaggagagagaggaaattacattttttttttcatcaagtcactaactgataggatggtgcccagcaacagtgaacatgtatctttcccaccccttctactgactcacacacccatctcctctagaaacaacctcacacagacacacccaaaataaagctttaccagcattgtaggtattccttaatccagtcaagttgacacctaaaattaaccatcacactagacttcttatagttctatcccaaacaactgtttgctcttaatggaacatcatttgttccaaataactcagagaatctcagcttaaacttcactttttccaggaagcctttcctgacctcctaataccaaattttccatatatcactgtttccttaacccttcgtaacacttctcattctcatagcacaactttgtccttgcctatttgtgagtttttaaaccttcattgaatacttgtgaggggtatacacatgcaaagatttgaaaaagacagcaacaaatatcaacagcaataatagtggcagtcatggcagcaaaaacaaacaaatgaaaatgcaagagtcgacagcaacggaagtaatgctatgaagtgttttcaagtagggtggaagcccttatatcataacatgagatactgaaggaacacattggagtctgaaaatctctgcagctaaaacaatacaaaggagagtatcatggcaatggaagactatgtaggacttaagaagaggactcccttcaaggatttgctgcctagctgtagggaatggggattgcagacagcctctagctgttagctctttcagtaacttaagtaatccattcaacaaccgtatgacttaagggcttctattagcattttcattttacaaataaagaaattgaagtacaaagcaattaagaaatttgcccatagttatagtacctgccagaggtgagatttcaacctagatgtagtgtaactcacagtggccatgttatgttgccctggagtggtcagaggaaatgaagaattcaaagagctggcagtccaggatatgggggtctgctcgggaagatgtgctgaagaattggtcagtacagtgattagaaaagatggccaccttcatcatgttggagctttaaaaaaatttatgattttccttatgattttaaatattagatttaaaaaatctctctcttctgttttctgacacaggaactttgtgatcttaaaaaactaagaatcctagacatagctggaaatattattcagatatttccatcaggagtaagtagagtcaacttccattataattgaaaaataattttgtttatgctattgggaatagaaaaaatatgggcagacagtaaaacctgtagtaattgaaaccttaaattatacaaatgactcaaagatttgcttttagaatttcaaaacctgttctctcctgtttttttctttgtgttctgtgcctgctgaacttgtttgaactaagttaactctgattgctatcacaaatattttaatatatcagctatgattaaattttttggttattacacactgcttttggtcacctctggctttttgaaaatattactttctggagcataaatttttatcccttgtaattaatccaaaggtgacacttttgttagtcatttttaggccataaacaatgaaaaatgcacttttttctcatttgaaaatgaattttgacctcattttatttcaaatatggagaaaccgtttgtcttggcaactcctaacttttgagaaagaaatgtcagtttttcctattgcatttttatatccaattgaacatgcttaaacattcatggtaataatgagaagtccatctatccagaaggtattcaatgaatagttgttgacccattaattatttttcctgatttatcccctctaaattgaggtttcagtctttttttacctcctagagcaatattttatactgaaggtaattcaaatataaaaaaatgagtgtaaagtctatgttttagaaaaaagtatagtttttaaattgtggcaaaatatacacaacataaaatttaccattttaatcatttctacttgtatagtccacggtactaagtactttcacattgttgcacaaccatcagcattatccatctctagaacctgttcatcttctccagctgaaactctgtatccattcaactccaactccccattccctttgtacacctattttagaagttcctataaatactttgaaataagatctttccccccttcatggcaaccacatatctactatatatctctgaatttgactactctaggtactctaggtaccagataagtggaaccagatatttgtccttttaccactgacttatttcacttagtaaaatatgactaacattaatttatcttataccatgtgtcagagtttctttcctttttaaggctgaataatattcagttgtatgtatataccacattttgtctatccacaggtatctgcccacctgtgggaccttgggctgttttctcattttggctattactgcaatgagcatgggtatacaaatatttgttctttatctgctttcagttcctctgggaatatccttagatgaaattgttgaatcatatggtaattctatgtttaattttttaaggaatcaccacagtgtttccaaaaatgtgtagatttgaatgtttagtaaaaattggatattgttaatattgaccttgaaaatgtgacatggttttatttaccctctgtgtcttaatttaactctctatgtcctgcgatgccttctggtgccacttcttctatggtacccctggtgccactgctacttctatggtatcttctggtgccacgttttctacggtatttctatggtatgcttgagcaacataatggagtaattcatttcaagtctttcttgcttttggatggtaaacttccagagaaagaatactctttttttcctctatacctgcagtgtcttgaattttaactcaataagtgtttgttaaatgaataaatctaactgatgttcttaaacttcatttattattcacctttcaccttcgtagtctgttaattgaccgtttcttctatgaagtgattctgtacttaacaattttgataaaacataattacttaggtcccaataatttggagtaattttgacaggtctgagttggtttcatctgtgtagtacctatttcaggaatttctataaacactctcacataagatgatctgcaaactcatctgagctttggtccaaccatttcaaattattttggttcaactgattcaaaatcaaagtttcccacattaaaaatatggcacaactggtggacctagaggagaaatgaccgactctaggtcacacaatgattatcagtgaaagagagtaagtttcaaaataatggtagagaacattcaaaacaagccatgctttttgtgaaacacagtagtgtagacatgaataacatagactttggagtcatatacacatggatttaaagcattaatttcctattttctaaattcgtaatctcaaacaagttgcttcatttctcagagttgctatttcttcatctatataacgacaatattaaaaccactaacctcataaggttgttatgtcaaatagtgattatgaagcattttgtgcatagttggtttccaggaatagaaactattatatgttgtgtataaaatatataccaataatgaaatactaataagtaatatataattatagcaatcatctactctctactggtgatgataggaagcattaaccttgtgaagtacatttttaaaaaccttttttaactatgagaatattcaaacatatataaaaacagacagaaaagcaaaataaagctctgtgtacccattacttttaagtgtactcttaactcaaagatttgaaactgcattgtgcataagtgcctttgaatagtttattttactgccttataactactttttaaaataggtatttatttaagagtgttttgctattttatgatttaaataaatttggtgtgcaatttagaaaatgcaatttttttcagagcagtatttttttttttttgaaattcacatggcatttgaacatttgaaactgtatttgcactaggacttttgtatacgaatatacattaaatgtaaatttacagtaaaaaattggactattataaatatttgttcatatgtgttggatcaaaagagtttctgtgttatttagttcctaagaaaaaatctggcatgaccacatagtgaattaattgtttcagaaatggccagatatggtggctcacggctgcaatcccagcatttcgggaggctgtggcgggaggattgcttttgattccatgagttcaagatcagcctggacaacatggtgaaacccctatctctacaaaacaaacaaaccaccaaaaaaattagctgggtttagtggtacaccctgtggtcccagttacttgaggtgaaagtatcactcaagcctgggaggtagaggttgcagtaagctgagatcatactccagcctgggcaacacagtgagaccctgtcttgaaaaaaaaaaaaagaaatatcttggttcttttatgaacatgtagtcagatctgctacagagagactttagtttctttccttacctcttttttcctttcttttattttaacttaaaaaaataaaacttaaaaattttgtaagttgtacaacttctgcatgtttcttaaaatgtgaagcaaaacaaaagtatggaataaaaataaaagtttcggccgggtgcagtggctcacgcctgtaatcccagcactttgggaggccgaggcgggtggatcacgaggtcaggagatcgagaccatcctggctaacacagttaaaccccatctctactaaaaatacaaaaaaattagcagggcgtggtggcgggtgcctgcagtcccagctactcccagctaattttgtatttttagtagagacggagtttctccatgttggtcaggctggttgcgaactcctgacctgaggtgatccgcccacttcggccctctcaaagtgctaggattacaggcgtatgtacaggagaatggtgtgaacccgggaggcggagcttgcagtgagccgagattgcaccactgcactccagcctgggcgacagagtaagactccgtctcaaaaaaagaaagtttccgttccaggacctcttcatgtgtgtttttagaaaagcctgttaaaacatttttttcacacgatactatgtctggattggtttcattatatttaatttcccagtatgatttttctttctaaaaaagtaccatctggccaggcgcggtggcttacgcctgtaatcctagcactttgagaggccgaagtgggcggatcacctcaggtcaggagttcgcaaccagcctgaccaacatggagaaactccgtctctactaaaaatacaaaattagctgggcgtggtggctcatgcctgtaatctcagttactcgggaggctgaggccagagaattgcttgaacccagaaggcagaggttgcggtgagccaacatcattgcaccattgcactccagcttcggcagcaaaagcgaaactccgtctcaaaaaaaaaaaaaaaaaaaaagtactatccaagtattctccataaggcattatcaatgtatcaatagcagaaagatcagcgagagaaagcaaaactctgggggctattttgatctgatctatctatcattgcacaattttagaacattctcagttttctcacatacaattttttgatacctaattcctgtctgagacataccaaattatttattgtattagtttgcaagtgtcctctgcttcttgaatgaatgggtattaagatttaagatgttgtcttcatttatccttttgtaagtagcatttttctggtaattcattcattgtagaaaataagtaaataagtatagaaagagtaaaatgtaaggtgtctttaagtttaccttccagagactacactttattgttttcttcaagaatctcatttttatattctcattaaaaaaattcaatgtatactgcataaagaaatacgtgtcttgctttgtcattttcatttaacattatatattaagcactttccttaaatgaatattcttcaatatgtgattttttttttttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaatatgtgatttttaatcattgggtgttcttctaccttttctttatcgtgtgttcactttttctgacatttttatttattgctggaattagaattggattttgaatgaacaagcctttgagaacaaggatgatctgaaataaaatgtcttttatttgtatctgtctttcagagaataacatatctgaagtatggcctttagtggacactggacaatttatggcaacactgtcggttgttcagttagtgcaggaaacagtgatgcttgttttattagtttcctgaggctgctatagcaaaatatcacaaactggggcttaaaggacatgtctttgttttctcttcttagaaggataccagtccttggattgtggcccactctaatccatatgacctcattttaactagttacatctgcaaagactctgtttccaaataaagtcacattctgaggttcagggtggatatgaatcttggaggacactatttaacccattatacttgatagaacattgagtttattactctatttggcatctgcaagggcaattgatataaacctccttgatgaggtttatatgactttccaattccataaacaattactgagtaccttctctgttgccaagctctcttctaatctggggaagtaaatgaagaaatatggatgttgctgtatagaaactttggaatttgtgtttgaagaaatctctaaacattgaagtggaacctggagatatcataagaacaagataaatatgtgatttttaatgatgtacagaaatttaaaatgagaaaaatcaaagaaactggcatgaattagcttgaacaaagatgcaagtcagctaggtggtaatttcattgttgagttcaaaataataaggggaaagtgacctgttgccttcataacttttgatgatggggaaagaaaaaacattattatttgctgctgaagggttttggataggctatcatcgtgggatttctgggaagaaaggattactaatatctttctttaggtcagaaaactcagtctatgaagtagttgtgattcagtcttttcaacagaaaaaaaagtaaattattgaaattttatatttcctttgaaacagtttttattttaatcttttagtcacaggtcttctttctctagctcctctttccctcaggagccccgttatttttcaaactgcaatcatttgaagaaaaagatgacctgacaaaagcaagaaaaagttttaatgatcatcaccagggagcatcatgagttttgtgtttgatgtgaagttcataacaaaatatcatatataaaatattgcagaccaaatagaaaacttcacatttaaataagctcttagaatcctccgttagcaatctatctaacaacctgtactattatgactacttttcaaattcacaaaaagttatctttctggatgaatactttgctgttatctaaaaatttgcaagttatcaaatctatttgttattgaataattccttgaagaagacagatttggtatcattattcctgtttggagctgaggatattgaggctccagagtagtttgtccgcagcagtgaccctcaaacttgaatgtgcatcagaatcccctggatgccttcttaaaacccagaaggctaggccctccttctaggatttctgagtcagtaggctggggatcccacaggtttgcatttctgttatgttctttggtaatgctgatgctgtaagtccaggaactacacttggaaaaccattggcctaaatgatggaacagtggcagaggttgaacttgcactcaagacttttggctacactgtcaggactccttctgcctctgaggaatccattctttgtcccaggttggggcagtctctgtcatgctatacaaataaggcatttctttgagctcactgggagtttgggttctgagaatttcactgtgtccttgactaaaatgatactcaaggaacattctttggacaatagaattcttgtatactctgaaaaatatttcacatagaaactaggattttggtatgtgaacacaaggaatgcctatatagttggaggctgagttttatatgttgtttaattcggttagccttacttctttttagccacactgtggatgtactcggtgcatatatgccacggacaaaacttcttaaacatttattcatcagccaatctaaaattggagagattttttagcatgtgaatttaacactaaattttattttggagaaatttggggaaggccaaatctttaccatgttactttcgtttctgagttttgtctttttaaagttcaccctttgccttgggtggttatagtttgggagtgaaactcaagtgtagctaaaacatttacaaggatacaaataaatgtgacaacttatgagaaagtgctttgctaagagtagacacttaagaaatgtgcttaaaaagatgtaaattatacccaatgctacattttccacagtcactgctttctttcagtttcaaattcatgatttaacattcatgtgaatctgtagcttccataaacacattctgtgtcagagttaagaatcttaagtatttgtatatccctaaggtttgtaggcacatactgtttttataagaaaaaaaacataaagcgggaaagcctcatacaatgttgtcatgagaaaaagtatgcttggactatttatgggaaatcatagttatagcacctattccgtttcatcaatgccccttttttccttcaagaattctttagagttatcataaataaaatttgagaatactgaaagcagtttcctcttttacagtatgagaaacacaggaggaaaaaaaaatggaagcaactttcccagaaatacaaatcatttgaatagtgaggagaaggtttgaatccatttttcccaaacaaaaattaaatttgcctagcttaacaatgtacccattgtgtgaccttggagaggtaactccattactctatgtctcacttttttcctctttaagttggggatattaataacacttgtatacatcacattgttaggaaagtgtctcacataacatttggtggtcagtaatgatagaatgaatgaataattaaatgagataatgtatatgaattcttattagtgtttggcacatgacagatattgaatgttattttcttgtcattttaaggtttggtctgagatacctgcccctcaatccaccccaaattttggggtgtctctgaaggctttcaaagccatgagatcacctgaatggttctaattcgtaactgttactgtaaccaactgatctgtacccaagggtgtacaagggtggctggtttcagcagtgcactctgctttctattccccatgttgtctttgcccctgttccaggttattttcctctgcagattcctttacattctttaggcttaccttccttgggcaacaaaacagaaccaataaactatctccctgaagggggtctcctttccctggctccttgcctttggttttctgtttatttctgtcttaccctttccctctcccttgtggctcatttggtttgtttgccagaccagattcctctggaaataggacctctcattactgaattccctttttcttagacacttcacttaactcgttgcctactacttatcctgacgtctcttcttttcttggatatttttaatttaaaaggatttctctttttatacccaatgatgaatgattttgatccacaccagtctaagcatatcttgctatggtgtccttggttccagacacatgcctgatatctagcatggtacataccctggtttactgtcactctctgtctgttacttgtctaattcaaatactaccggtatcttttgttagtacataaatattttttgtgcttaatacaaaatcaagtgaagaaaaccattttatttttggatgattctcatttccaaatgaattcatctgccttcaatagaatgatttccatatatgagcagtaacacaaatatgtgcacatacagacaagcattcctagggagaccatttagttttgcattaacagaaatatttctgtgaaattgattgaacacttggagaatgtctatttcaaatttaaacatgtccatgatcaaaaatgtccttaagtggtccagaaagtgcaatacaattgtgggaaagaaactccttgggaaagtgaaattgtggtttgccttgtatcaaaactcctatcaaaacttttgaaactcttttgcaagatggtagaaaatagcctaaaagtttaaaagtgatacacagggaaaggtccataaagctgtggtcaagaacatccctgaatatctccacaatatagtgatttccttggaactatccactttgctcaaatagccatgagaaattccagttggctgcctcatccccattgttgttctgcctcttttgattagcagcattagagatccactttattcttgttcccatatgaatagtttattttctctgtttaatgttaaggaaaagtataccctattcttgaagctctttaaatgcctctctaaaatttgaccttgattttaaaatagtataattttctttggttgtcagtgctgctttcagtggctcagtttattaggagccatacatttaaaacaacattcactgaccttttaaaaaatgggaaacaagccaatgctattctaatggaaaccccttgtgggttctgtggttttatgtaagtgatgtaagcttagctaatatagaattagtgagttccaaaacttgactaaatgctttccctgtcactacttttatgagaatgagatcatattttctgctgtttcttatatgggggtgggtgaagaagagggtgttgaattatatgttattgcttctttcaccattgtaattctaaaatttcatggggtagactttttgaaatgaaaagcagagagaaaaaattatgaaatattatccttgatgcaatggtgattttgttcaaattcttgttttaaaaattgagggcccaattaagttagggaatacaactatctttctctttttagttaacttacataatttgagttctgactttctacttctatatgtgattttattagaattaaagataggctggtcctgaatgcctataaaatgtaagtgctgcagaggaccctgtttcacatggtatagtggttggtgaacagcatttcaccaaccactatcgctagctacccttggaaattttattcttctaaccaagtacctaatgaaagtaattcaggagataaaggggatgccttgcttaccttcaaaatggagatcctcaaatttcagcaacattcacctctcatctctcttgttgagaggccagaaggacaggatcataaagtcagagagctggaacttctgtgtttttagtcttgcagtaaaagtggagttaaaatgatttcaaaatcagggccaatatttttgagaaagtaaactttaaaaaattaaaaatattataaagagagtctgattgaaatcaaatgtggctcttgtacagactgtttaagcattgattttcatttagatgatttctctctcccttacatctccaagtaatctctatggagttcggggtttttgtccctttcactgatgtattccaagcttataacagtgcttggcacagagtaggcacccaataaataattacagaaaggatgggtagatggatagattgatgggtgggtagatatggattttacataacaaacatgattgctttgctcctctgaaaaatcaaaactaatttgtcacaattaataataaagttgttttaaggcagtggatttcaaccagggaagatttagccctccctccatgtcccagggatatttgacaatgtctggagatatttttggttgtgaaaactgaggagtgatactgctggcatctagtgagtagaagccagaaatcctgctaaatgttctgtaatgcataggacagtccccccataacaaagtattacctggcccaaaatgtccatgttgagattgagaaactagtttacattcctaccaagttgatttaagggattgactatttctttgtgttctccaggctttaatcctaataaaatatatctttatcaagtagattttagagtctataagaatcagcaatatgcctgttaaaatgttgatccctgggccccatgctcatatattgtaaattattgctaataatgctttggctttaaagtttatttttttctcatatgaatatagctatattatatataaacatataatatatattatatataaacatatattatatataaacatattatatattatatatattttgattcacgtttacatgatatatctattttcactgcctactttcaacctttttatatccttatattttagatgtatcttttataagtaccatataatacttcatttaaaaaaatccatctgactattctttttttctctttgtttgagacgaggtctcactattttgcccaggctggtcttgaactcctgagcttaagctatcttcccacttcagcctcctgagtagttgggactgcaggcatgtgccactttgcccagcctgctgtgtatatttaatttgttctacttgttctgtactccttttctgttttttcttttgaaataattggatacttcttaatgacacattttaaaaaatcttacgaagttttatatcattttactattcctattttaaaatttattttattttaggttctggggtacatgtgcagaatgtgcaggtttgttacataggtaaacctgtgccatggtggtttgctgtacctatcaacccatcacctaggtattaaaacctgcctgcattagctatttgttctgattttctccccacctggcccccccaacaggccttggtgtgtattgttcccttccctgtgtccatgtattctcattgttcagctcccacatatgagtgagaacatgcggtgtttggttttctgttcctgggttaatttgctgagtatgatggcttccagcttcatccatgtccctgcaaaggacatgatctcatgcctttttatggctgcatactattccatggtgtatgtgtaccaattttttttattatactttaagttttagggtacatgtacacaacgtgcaggttagttacatatgtatacatgtgccatgttggtgtgctgcacccattaacttgtcatttaacattaggtatatctcctaatgctatacctccccgctccccccaccccacatcaggccccagtgtgtgatgttccccttcctgtgtccatgtgttctcattgttcaattcccacctatgagtaagaacatgcagtgtttggttttttgtccttgtgatagtctgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctatcgtgaatagtgccgcaataaacatacatgtgcatgtgtctttatagcagcatgatttataatcctttgggtatataaccagtaatgggatggctgggtcaaatggtatttctagttctagatccctgacgaatcaccacactgacttccacaagggttgaactagtttacagtcccaccaacagtgtaaaagcgttcctatttctccacatcctctccagcacctgttgtttcctgactttttaatgattgccattctaactggtgtgagatgttatctcattgtggttttgatttgcatttctctgatggtcagtgatgatgagcattttttcatgtgtcttttggcggcataaatgtcttcttttgagaaatgtctgttcatatcgttcacccactttttgatggggttgtttgtttttttcttgtaaatttgtttgagttctttgtagattctggatattagccctttgtcaaatgagtagattgcaaaaattttctcccattttgtaggttgcctgttcactctgatggtactttgttttgctgtgcagaagctctttagtttaattagatcccatttgtcaattttggcttttgttgccattgcttttggtgttttagacatggagtccttgcccatgcccatgtcctgaatggtattgcctaggttttcttctagggtttttatggttttaggtctaacatttaagtctttaatccattcttgaattaatttttgtataaggtgtaaggaagggatccagtttcagctttctacatatggctagccagttttcccagcaccatttattaaatagggaatcctttctccatttcttgtttttgtcaggtttgtcaaagatcaggtggttgtacatatgcggcattatttctgagggctctgttctgttccattggtctatatctctgttttggtaccagtaccatgctgttttggttactgtagccttgtagtatagtttgaagtcaggtagcgtgatgcctccagctttgttcttttggttttggatcgacttggcactgtgggctcttttttggttccatatgaactttaaagtagttttttccaattctgtgaagaaagtcattgttagcttgatggggatggcattgaatctataaattaccttgggcagtatggccattttcatgatattgattcttcctacccatgagcatggaatgttcttccatttgtttgtatcctcttttacttcattgagcagtggtttgtagttctccttgaagaggtccttcacgtcccttgtaagttggattcctaggtattttattctctttgaagcagttgtcaatgggagttcactcatgatttggctctctgtttgtctattattggtgtataagaatgctgtgatgtttgcacattgattttgtatcctgagactttgctgaagttgcctatcagcttaaggagattttgggctgagacaatggggttttctagatatataatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccaattttcaaatggaatgcttccagtttttgcccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtcattggttctgtttatgtgctggattacgtttattgatttgcgtatattgaaccagccttgcatcccagagatgaagcccatttgatcatggtggataagctttttgatgtgctgctggattcagtttgccagtattttattgaggatttttgcgtcaatgttcatcagggatattggtctaaaattctctttttttgttgtgtctctgccaggctttggtatcaggataatgctggcctcataaaatgagttagggaggattctctctttttctactgattggaatagtttcagaaggaatggtaccagctcctctttgtacctctggtagaattcggctgtgaatccatctggtcctggattttttttggttggtaagctattaattattgcctcaatttcagagcctgttattggtctattcagagattcaacttcttcctggtttagtcttgggagagtgtatgtgtcgaggaatttatccatttcttctagactttctagtttgtttgcatagaggtgtttatagtattctctgatggtagtttgtatttctgtgggatcgttggtgatatcctctttatcattttttattgtgtctgtttcattcttctctctttttttctttattagtcttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgtgagggtgtcaattttggatctttcctgctttgtcttgtgggcatttagtgctataaatttccctctacacagtgctttgcatgtgtcccagagattctggtatgttgtgtctttgttctcggtggtttcaaagaacatctttatttctgccttcgtttcattatgtacccagtagtcattcaggagcaggttgttccgtttccatgtagttgagtggttttgagtgagtttcttaatcctgagttctagtttgattgcactgtggtctgagggacagtttgttataatttctgttcttttacatttgctgaggagtgctttacttccaactatgtatgtaccacatttttttaatccagtctgtcattgatgggcatttgggtttgttccaagtctttgctattgtgaatagtgctgcagtaagcatatgtgtacatgtatctttataatagaatgatttatatccctttgggtattatacccagtaatgggattgctgggtcaaatggtatttctggttctagatcattgaggaatcaccacactgtcttccacagtggttgaactaatttacattcccaccaacagtgtaaaagtgttcttatttctctgcagccttgccaggatctgttgtttcttgactttttaataattgccattctgacttttgtgggatggtatctcattgtggttttaatttgcatttctctaatgatcagtgatgttgagctttttttttcatatgtttcttggccgcataaatgtcttcttttgagaagtgtgttcgtgtcctttgcccactttttgatgtttatttttcttgcaaatttgtttaagttccttgtaaattctgaatattagacctttgtcagatgggtagtttgcaaaaattttctcctattctgtaggttgcctgttcgctctggtgatagtttcttttgctgtgcatacactctttaattagatcccatttgtctatttttgcttttgttgccattgcttttggtgatttcatcataatatctttgcgcatgcctattttctgagtagtattgcctgcgttttcttctagggtttttatggtttttggttttatatttaagtcttcaatcttgagttaatttttgcataaggtgtaaggaaggggtgcagtttcagttttccacatatggctagccagttttcctagcaccatttattaaatagggaatactttccccattgcttgttttgtcaggtttgttgaagatcagatggttgtagatttgaggtcttatttctgagatgtctattctgttcccttggtctaagtgtctgttttgttaccagtaccatgctgttttggttactgtagccttgtagtatagtttgaagtcaggtagcatgatgcctacagttttgttctttttgcttaggattgtcttggctgttagagttcttttttgtttccatacaaattttaaagtagttttctctaattctgtgaagaatgtcaatggtaatttgatgggtatagcattgaatctataaattactttggacattatggccattttcacaatattgattcttcctatccacaagaatgtagtgtttttccatttgtttgttttctctcttatttccttgagcagtggtttgtgagtgtacacaataaccagctagcatcatgatgacattatcaaattcacacataacaatatttaccttaaaagtaaatgggctaaataccccaattaaaagacacagactgacaaattggataaagtgtcaagacccatcagtgtgctgtattcaagagacccatctcatgtgccaagatacacataggctcaaaataaagggatggaagaaaatttaccaagcaaatggcaagcagataaaagcagaggttgcaattgtagtttctaacaaacagactttaaaccaacaaaaatcaaaaaagaaaagggcagtatataatggtaaagggatcaacaagaagagctaactatcctaaatatatatgcacccaatacaggaggacccagatttgtaacgcaagttcttagagaactacaaggagacttagactcccacacaataatagtaggagactttaacgccccactgtcaatattagatcattgagacagaaaattaacaaggatattcaggacttgaactcaactctggatcaagtggacctgatagatatctacaaaactttccacccccaaacaacagaatatacagtcttctcagtgccacgtggtacttactctaaaattgatgaaataattggaagtaaagcactcctcagcaaattgcaaaacaactgaaataataacaaacagtctctcagaccgctgtgcaatcaaattagaactcaagattaagaaacttactcaaaaccacacaactacatggaaattgaacaacctgctcctgaatgactcctgagtaaataatgaaattaaggcagaaatcaaaatgttctttggaaacagtgagaacaaagagacaatgtaccagaatctctgggatgcagctaaagcagtgataagagggaaattatagtactaaatgcccacataagaaagctagaaagatctcaaattgacaccctaacatcacaactaaaagaactagagaagcaagagcaaacaaatccaaaagctaggagaagacaggaaataactaagatcagagcagaactgaaggagatagagacatgaaaaatccttcaaaaaaaatcaatgaatccaggagctggttttttgaaaaaattaataaaatagatagactgctagctacactaataaagaagaaaagggagaagaatcaaataggctcaatgaaaactacaaagggcatatcaccactgaccccaaagaaatagaaacaaccatcagagaatactataaatacctctttgcaaataaactagaaaatctagaagaaatggatcaattcctggacacatacaccctcccaagactaaaccaggaagaagtcaaattcttgaatagaccaataacaagttctgaaattgaggcaggaataaataacctaccaaccaaagaaaaaaaaaagcccaggatcagatggattcacagctgaatgctaccagaagtacaaagaggagttggtaccattccccattccttctgaaactattccaaataattcaaaaggagacactcctccctaactcattttgtgaggccagcatcattctgataccaaagcctggcagacacacaacaaaaaaaacttcaggccaatatctctgatgagtattgatgcaaaaatccccaataaaatactggcaaactgaattcaacagcacatcacaaagtttatccaccatggtcaagtggtcttcattcatgggatgcaaggctggttcaacatatgcaaatcaataaatataattcatcatataaatagaaccaaggacaaaaaccccatgattatctcaatagatgcagacagtcttcgataaaattcaacatcccttcatgttaaaaactctcaataaactaggtattaatggaacatatctcaaaataataagaactatttatgacaaacccacagccaatatcacatggaatggggaaaagctggaagcatttcctttggaaactggcacaagacaatcatgcattctctcaccactcgtattcaatgtagtattggaaattctggccaggtcaatcaggtaagagaaagaaataaagggttttcaaatatgaaaaaggaaatcaaattgtctctgtttgcagatgacacgatcctatatccagaaaaccccgtcgtctcaacccaagagatccttaagctgataagcaacttcagcaaagtctcaggatagaaaatcaatgtgcaaaaagttacaagcattcctatacaccaacaggagacaagcagagagccaaatcatgaatgaacttccattcacaattgctacaaagagattaaaatatgtaggaatacagctaacaaaggatgtgaaggacctcttcaaggagaaccatttgtctattattttaactgactaccctaaaaattaaaaaaaattattgtgtgctttatgaaaagtatttatttgatacttattctctcctcttagacaatttaaaactttctattacatacctccatctttttaaaaaatttttaagcaacacataataattgtacatatttgtgggggtgcagagtgagatttttatacatatatacaatgagtaatgattgaatcagagtaattagcatatccattacctcaaatattcatcatttctttgtgctggaaacattcaacaacctatctatttgaaattcatctatttgaaaacatacaataaattactaactatagtcaccctacagtgctatagaatactagaacactagaacttatttctcctctctagctgtaattttgtatttgttaactaacgttttcctcacctcttccctactcttcccagcctctaataaccactattctactctctacttctatgaactcaacatttttatctcacacatgagtgataacatgcggtatttatctttctgtgcctgacttattttacttaatataatgtcctccaggttcatccatattgcctcgaatgacaggatttcattctttttatgactaaataatattctttttgtgaatatgtatgtgtgtgtatatatatatatacacaacatatatatatacaacatatatatatacaacatatatatatacacacaccatatatatatatgaaacattttccttattccttaatcttttgctggatacttaggttgactacatattgtactactgtaaacatgggggtgcagatgtttctttgatatactgatttcctttggaaatagtagtggtagtgctagatcatatggtagttctattcatagatttttgaggaaacttcatactgtttttcataatggatgtactaatttatgttcccatttacagtgtatgagttttctttgtgttctcaccagcatttatttatttttatttgtttctatttgttacaacaaattcaaacttttggacaagagccattccaactgggatgagatatgtcttactgtggtttagatttgcattttcctggatgattagtgatgttggacctgtttttcagatacttgttggccatttgtgtgtcttcatttgagaaatgtctattcagatccttcaccaatttttaaatcaaattatttggggtttccttttgctcttgagttgggttcttttttattctgtatattaatcacttgtaggatgaatggcttggaaatgttttctgcctttctacaagttatctcttcactcagttgattgtttcctttaatatgcagaaacttttaagtttgatataatcatgtctatttttgcttttgttgtccgtggtttggagtattttttaattctctttttaaaaaaaatattctttctattttgattttgagtcttacccacaaaatctttgcccacactaattcctgaagtgtttcccttatgttttcttgtagcaattctatagtttcaggtcttacatttaagtctttaattcatcttgagttgatttttgtttatggtgggagatatgagtctagtttcaatcttctgtgtatggatattcaattttcccagcaccgttttttgaagaggctctcctttcagtgtatgttcctggcacctttgtcaaaaatcagttgactgtaaatatatggatttatttctgggttctctattctgttccattggtctaagtgtcttttttaaaccagttctatgctgttttggttactatagctttgtggtatattttgaagtcaggtagtttgatgactctaggtttgttctttttgctcagaattgctttggttcttgggggtcttctgtggttccatataaattttagaattgctttctctgtttctgtgaagagtgtcattggtattttgatagggattgcttcgaatctgtagattgctttgtgtaatataatcactttaacattatgaattctgacattagaaagcacacttcacctctctaatgtgacctttctcacaggtgtgcctccttcagcttcccatgtggcacccacagaaacattcacctatgaatggactgtccccaaagaagtaggacccactaatgcagatcctgtatgtctagctaagatgtattattctgctgtggatcccactaaagatatattcactgggcttattgggccaatgaaaatatgcaagaaaggaagtttacatgcaaattggagacagaaagatgtagacaaggagttctatttgtttcctatagtatttaatgagaatgagggtttactcctggaagataatatcagaatgtttacaactgcacctgatcaggtggataaggcagatgaagactttcaggaatctaataaaatgcactggacttttaatgttgaatgccttacagctagctgatcattacacaggcggcatgaagcaaaaatatactgtgaaccaatgcaggtggcagtctgaggattccaccttctacctgggagagaggacatactatatcgcagcagtggaagtggaatgggattattccccacaaagggagtgggaaaaggagctgcatcatttacaagagcagaatgtttcaaatgcatttttagataagggagagttttacataggctcaaagtacaagaaagttgtgtatcggcagtatactgattgcacgttccgtattccagtggagagaaaagctgaagaagaacatctgggaattctaggtctacaacttcatgcagatgttggagacaaagtcaaaattatctttaaaaacatgaccacaaggccctactcaatacatgcccatggggtacaaacggagagttctacatttattccagcattaccaggtgaaactctcacttacctatggaaaatcccagaaagatctggagctggaacagaggattctgcttgtattccatgggcttactattcaactgtggatcaagttaaggatctctacagtggattaattggccccctgattgtttgtcgaagacattacttgaaagtattcaatcccagaaagaaactggaatttacccttctgtttctagtttttgatgagaatgaatcttggtatttagatgacaacatcaaaacaaactctgatcaccccaagaaagtaaacaaagatgatgaggaattcatagaaagcaataaaatgcatgctgttaatggaagaatgtttggaaacccacaaggcctcacaatgcacatgggagatgaagccaatgggcgatgaaatagacttacacactgtacattttcacggccatagcttctaatacaagcacaggggtgtttatagttctgatgtctttgacattttccctggaacataccaaaccctagaaatgtttccaagaacacctggaatttggttactccactgccatgtgactgaccacattcatgctggaatggaaaccacttacattgttctacaaaatgaagacaccaagtctggctgaatgaaatacattggtgataagtggaaaaaagagaaaaaccaatgattcataacaatgtatgtgaaagtgtaaaatagaatgttactttggaatgactataaacattgaaagaagactggaaacatacaactttgtgcatttgtgggggaaaactattaattttttgcaaatggaaacatcaacagactatataatgatacatgactgacacttgtacactaggtaataaaattgattcctacagtctaatcatatcaccactattagggttttataaaactgcatttaaaaaaagatctatgaccagatattctcctgtgtgctcctcaaaggaacactattaaggttcattgaaatgttttcaatcattgccttcccattgatccttctaacatgctgttgacatcacacctaatattcagagggaatgggcaaggtatgagggaaggaaataaaacataaaataaataaaatagaatgacacaaatctgagttttgtgaacccctgaagggatggtctaaaggacgttatctggaactggagaaaagcagagttgagatacaattctatagattaaatcctggtaaggataaacattgccattagaagaaaagcttcaaaatagacctgtggcagatgtcacataagtagaatttctgccaagccttaactgcattcagaggataatatcaatgaactaaacttgaactaaaaattttttaaacaaaaagttataaatgaagacacatggttgtgaatacaatgacatatttctttattttcacatacactctagctgaaagagcaagagtacacatcaacaaaaaaatgggaacaaggctttggctgaaaaaaacatgcatttgacaaatcatgttaatagctagacaagaagaaagttagctttgtaaactacttcatttgattcagagaaatagagcatgagttttcttaaagtaaaaagaaaaggaacaaagaaaatgaggtttgaaattttttaccatggcaaaatattaacatctttctcaaaaacatagagaaatctggaaaaatcaagaagataaaattctggaccagttagtgacattctttcaagcatacttgtaaaatgtttccttagagtgttcttgggatgaaaatgattgtcatgtctccaacaacagtgaactgatgttgttccttggaataaaagtcaatccccaccttaaaaaaaacaaaacaacaacaacaacaacaaaaatatgaattcttccaatccatgaacatgagatgtctttccatttttgtgtttgccctctttaatttcttttagcagtattttgtaggtatcattgtggaaatctttcacctttttggataaatttatttttagctttaaaaatcttttgtagctactgtaaatgggataattttttcttgatgaattatttattactggtttatagaatcactactgatttttgtttggttgattttgtatcctgcaactttattgaatttgttaattagttcaaacaggttttttggcggaatctttagttttttgtttttttttttaaatatataagataatgtcatctgcaaatagggacaatttgacttcttgtttcttaatttcattccttactatttctttgtcttgcctaattactctcttaggaactccagtactgacatggtttggctctgtgtccccacccaaatctcatgttgaattgtaatctccaatgttgggggagggacctggtgggaggtgattggattatgggtgcagatttaccccctactgttcttgtgatagtgagttcttatgagatctggttgtttaaaaatgcacagcacttcccccttctctctcctgctgaccatgtgaagatgtgccttgcttcccctttatcttcttccatgattgtaagtttactgaggcctctccagccatgcctcatgtacagcctgtggaaccatgagtcaattaaacctcttttcttcataaactacccagtctcaggcagttctttatagcagtgtgagaatggagtaatacaagtattatactatgttgaataagagtggtaaaaaataggcatccttgtcttgctccagatttcagaggaaaagcatttttcttttccctgctgaaagcttttccatactcactatgattttactgtgggtttatcacatacggcctttactttgtttagtcatattcctttaatacctaatttgttgagagtttttatcatgacaaggtgtagaattttatcaaatccgttttctgcctctattgggatgatcatatgatttctacccttcattctgttgatatgatgtattatatatttacttattagcatatattgaaccatccttgaatccatggcctaaatccacttgatcatggtgtgtaatcattttgatatactgttggattccatttgctactatttttttaaggtttttgcatctgtgttcatcaaggttattcatttgtagtttttcttgttgttgttgtgtccttttgtggttttggtataagggaaatgctggccttgaagaatgagttaggaagaatttccttctttcttttcggaatggtttgagaaaagtggatgttagtttcttaaaagtttgatagaatttagcagtgaagttatgcagtcctgggcttttttgtttgtttattttgggagacttattactgtttcaatctcattactcattactgatctgtttaggttttctatttcttcctggttcaaccttgttaaattatatgtgtgcagaaatttatctgttttctctaggttttccaattttttggcatatagttgttcataataatctctaatgatcctttgcgttctgtgatattaatgtgtctcctttttcatttctaattttatgtattggaatcttctgtctctttttagtctaatgccatgttgattttgtttatcttttcaaacaactttttaaatttgctttttattctctattttgtttatttctgcgctaattttctttctttctttctactaattttgggtttaatttgttcttgcttttctagatccttgaggtgcattgtcagattgtttatttaaaatctttctaatttttgttgtaggtgttcattgctataaacttccctcttagtaatgcttttactatatttaataggttttggtatgcagtgtttctgttttcatttgtttcaagaaacttaaaagttttcttcttaatttctttattcacctttggtgactcaggagcacattgttacacttttatgtgtttgtacagtttccacagttcctcttgttattgattcatagttttattccattgtgatctgaaagatacttatgattttgatttttaaaaatttgttgagacttgttttatgtcctaacatatggtttatcctggagaatgttccatgtgctggaaagaagaatgtgtattctgcagctgttggatgacatgttttataaatgtctgttaggtccatttgattttgtagtgcagtttaagtctgatgtttcttcattgattttctgtctggatactctgtccagtgctgagagtggagcgttgagtccccaactattattgtactagggtctatctctccctttagttctactgatacttgctttatatatctggctgttccagtgttgggtgcatatacatttacatatgttatatcctcttactgaattaatccctttatcattatataatgaccttctttgttcctttttatattttttgacttgaagtctgtttcatctaatgtaagtatagttactcctgctcacttttgttttccatttgtatggaacatcttttcccatcccttaactttcagtctatgtgtgttgttgcaggtaagtgagttttttgtaggcagaatatagttgggtcttatgtttttatccattcagcctgtttaaatcttatagttgggaaaatttaaactgtttatattcaatattgttattgatggtgagtacttacttatctttttgcctccctccacctctgctttccattcttttgtctccctgtgtttagttctagatatgttctcctgatatattttacaaattaatactttttttttcagctttgtctacatgttgtcaaacctacccattagattatgtatttcagttttatttattgttacaatttcttgttggttctttttcaaatctactatgttactttttacacttttcatttatctcctgaaaatcttaaacttggcttttattttccagatcatgttaagtgtagttatttctatcttatattcccatggttgtcttttttgtattatatagatctcagctcagatatcaactcctcaggagagcttttcctcacaactcagtcaaagtagcctctactctatgacatcaaattttaaatttttctttatggcacttaccactgtaataaatacatgtttagatttgtttacttgcttattgtttttatgtacccaccctccatttttttagcctccatagaatgcaaatttccatgaaaacagcatctttgcctgtttattcattgctgtattttattgccaagagcagtccttggcaaataataagcatacataataagcaacaatacacattgttgaatgaatgaatgactgaatagctttatcatagcctttgtctgatttccctacacttcatctaatgttcacaagtcacaaactttgggagggtctcaaaaatcttctctgaccttgatgtcagaacttgtctccatcttgatcctacttctctcaacttccactttatttgcttgcttttatattgctttcctgttccacttatttttcagaagactttgtgttctttcttctaagaccactttaaggtaaatctctttaatagctgcattacatttctattatagttatatttccttttaaattttatcaggtagttaaaattatataaacccctaaaaattcttactgctatggctgccaagtttagaaaaaaattaaaagattatagttttaaaatcaatatttttttctatattttgagctctaattttattggccacacttttcatatcttctattataaattacaaagttcttagaggataatggaatatatattaaaatacaagccaaatcaaaaataaaaattcagctcttgactgagaaggtatctcaagagacttccaaagctccctatataaaatttcagggaatttcagaatattttatttgttgtcaggagtgagagtatgaggcaaggcaatcaattttttcattattcttaagatttttatgaagtgggatcaaataaatttatagaaaagttcctacaactttataaatgttagctttctcttgttttttctccaagtgcccatatacagaaaatcacattgtaaattgggattgtggagaaggtattgtgagataggtatagtgattagaggcagtaaatatggaaggttctagaatataatgagggttaaaaactaacttctctgtcaagaagacaactacccaaaggtgtcaggaaactaggctcagaaaatagctcattcttttgttagagccaggactgctttcctttaggaaaagctggcaaggaaattccatggcctagaagtctgaagattaaggtcagaaccttcaaagatggccaaagtccatcgtagaaggctactcttcagtctggggtatactcagaatggttagctatggtttcatctatctaggtcacagatgctttctggaaacagtaatatgccaagaaaggatatgtaaagttgctatataaaaacaaacaatggttaataatattttttgaaaactatgctggttttgtgctaaacactttaaatagtatccttttatttaattttcattatagtttcatgagctaggaactattaccatttccattttacagatgataaaactgaggctttcagaaaagattaaggtacttttctcaatttcagagctgaaactcaaacctaggttgcttcaaaaccaaaaatactcttaattactagtagtgatttatataaacatattatgcctgattatcatgtattgttcttgactgttcgttaatattgcatgttcttttaattgttgaggaagacttgactgagttgaactagccagagaagggactgatctgtgaattccttccttgctgctacatacctccctaactcctataggctcactttagaaaatagaagtcaagactcctacgaaggttcatttgagatgggaaggttggtgaatagacattttgtgcctggtaattaggaggaacaattggcaacatctgtagttcccccacaaaaggaaaattttgcctaatttttgagaggaagaaaggatattctctggcaccatatcttagagtctttgctggcattcctgtagtccaggataaaatgggaatgtcaaagaaatttcaggtgcggttttataggagggtacattaaagaaaaagcagagctgaaagtcaaggaaataattccaaacagaaggcactgggttagtaaaagacttaggcaacttagctgtgcaggggatgccatgcaactgaatcacaaagggtgacacactaggtgaccctcagaaaagctgatcgtgtcactgtggggagaccatgaggtttttgttactgtagttgcttgtttcagaatgcaaaagttttgcttcctttctctttcttatacttgtaagaagggagttagtgctaatatattaaaataatctggtggcaagatttctcaggtggtttggtgcgtatttggacctcagatttttttctatgtgcatctctgtcatgagaattatagctgattcaagtcacatgtacaactctaataaagacatgcagttaatgggttttctgtttttgtgtagtagatatattttaatttttttcattaatggaagaagtatgatgggtgaaaacatcagacagagtctggaatcagacaaacttgggttttaattctgacaatacttatggttgacgttttatgattcctgcagataacagctattgcaagagatccctgagttggctgtagaagaatgcaggtttttcttggtatatttctttacaaattagctttcccagggaaatctagtgagcaagattttggtagtaacctcttttttaggtcataatagagtgaagggcagccagagtgctgacttggttggggcagcattgtgtagtagaaaacacatgaactttcatgcactgcatatgaattccagttttgcaactttctaactgtgtgacttcgggaaaattttaattgaacttgaactttaattcctttatctaaaaaatgggataataatacaaatgatactgtctaccatgaggattgactgagctaacaaatataaatcaccaggaacatagcaagtactttgaatattacattagttctaattcctgtcttcccttgtcaccatcaaagctccagcatgttcctccacctcatacacactattacagtagtgtaggactgccaccataatgtcagaaccttagacaaattgtgctagaaggtggtattattgctttcttgccactcatttttccttaggctaccctacatatatgggagtcctctggggcaatctaacctggacaatgagagaacagatgggaagagggggttgtaaaataaactgaaaaaaaaaaaaaaaaaaaaaaaacctatgaatacctgaaaatcctaatattagcaattttgaaaaactttatggcaggaagaggaattataatttatattccttgatcaaagatatgctctgtaaagcaagaagaaaacaaaatcaaacatatagcttgtgttaaatattagcgtggaaaagggcactttacgaaattgttttatgggatacatatacaattgttactcaattattcactattttagagtgcaagttccactgaaagtgccctggggaatggcaagtagagtcagtccagtactacccgtcctcatataaaaagaacaagatttatgcctccacagaggaagctcaagactgccaaccaaacgctgttatttaacaaaggttctgcccctggtcgttttcagacacagagctggttatagattctgttgttcttttccccacctacactccggtgcctttgcccactttgctggatagtcacagtttttagttacagtttttgccccactccctgttgggctgtgatacttcttcaaagattcagagatttggagggtaaagaaagcaagaggagggcaccatgctgaaaactcagtgagtactacaggagcagcaaaataaggactgcttctagggaaggctgtagtagtctgttgttatgctgttaataaagacatacccgagactgggtaattataaaggaaagaagtttaattgcttcacagttccatatggttggggaggcctcacaatcatggcggaaggaagtaggaacaagtcatattttatatggctgcagggaagggagaacttgtgcaggggtactcctttttataaaaccatcagatctagtgagacttattcactatcacgagaacagcccgggaaagacccgcccctatgattcaatatccttccactggctccctccgacaacacatggaaattgtgggagctacaattcaagattggatttgtatggagacacagccaaaccatatcaaggggagaaactggaaagctcaacggaatgctttcagcactaatatatacaaggaagtgagatgtgaaacatccagtgttttgctagtaaatgtttaacacaatcagctccctggggcgccagagcggaaccctcgtttgtagcatctgctaattcccataatgtaaatactcccaccatggcctgtttcaagctaccaatataatgtcactaaaagccatgttggacattgatgctcagaactggctcttctgtgttggtgccagtcagcacaccagtgatagtagccttagcaccactgactgagacagggaggatatggtagagaattttaagagacgatgttccctttttggtgatagaaattcttaaaatattagctttactgctttattaactgtatgactttctgtagagatccttaaattccccaagtctcaatttccttatttattaatatatgtattcgatatacattttctgagtgtcttttgtatgccaggaacttttgtagacatctggatacagaggtgaataatacaaattccctgccctcttggagcttataatctagtagggaagactgataatacacaggtaaacaaatttaaggtagtgtcatgaagaaaacgcttagggcattgtaagcccaggaggggaaattttgtctgttttgggcactgctgtgtcctcagtgcttacgacattgtaagaatgattcagagtataaatgaaggctctggtactctaattagggcttttggaaaagactgaggggccgaaagatgaccagaaatatgtgattgatatacaagaacaaatgtggcaggtgctgttgggtagctgctgacacccccatctccagccctcctctcctgaactacttccagtgggagtggtcatgtgtcacagttctggctagggaaaaataaatggaaatcttttgggtgggatttccaggaaagcttttgtttttcctataaattggacagactttatctcttgccccttggtcttttcttgtttgtgttgcctgaatttgattgagaattagcagccatttgggactgtaaagtgcaagcacgaagacaacaacctacctgctaagcaggatggacctctggcagcagcattgcacagccttactactcctggcctgctcaacttgtgacacttgttacatgagataaatgacactctatgtgttgtctgtttttttgtgttttgtgtttttttttgcaattaatatagcaagccaggccataaaaatatagaaagaataatgaatactaaataagtcatataaaacagtagaatttaagaaacattgctcaaaaaatgttgctcttaatatcataatgactcaagtaataaagaatcattacatacttttgagcccttattctgtgctttataataggaatcataataatgtgagtgattccagagtcaaatacaaaaaacaaactgaatttaaaatcttgggactaacgttaatagctgtcagttgacacttcatcaacaattcagacacttatatttcaaaacaggaagcaacaaaatgcttggaaaaagatccaggactttataaaatattgtcctttttagagctggaggccataatcctaagcaaactaacccaggaacagaaaactaaatactgcatgttcttacttataagtaggagctaaacactgaatacacatggaccaaaatagggaacaacagacacagcggcctatttgagggtagaaagtgggaggagggagaggattaaaaaactctctatcaagtactatgattattacctgggtgatgaaataatctgtataccaacctccatgaaatacaatttacctatataacaaacctgcacatgtacccttgaacctaaaataaaagttaaatttagaaaatattatctttttggtatagaaatttcaatatagaagcaaattactgaagagtttcctgacacaaaggagcatgagtacatgtacatatgtgtgtatataattttttttttattataccttaagttttagggtacatgtgcacattgtgcagcttagttacatatgtatacatgtgccatgctggtgcgctgcacccactaactcatcatctagcattaggtatatctcccaatgctatcccctccccccctacccccaccccacaacagtccccagagtgtgatattccccttcctgtgtccatgtgatctcattgttcaattcccacctatgagtgagaacatgcagtgtttggttttttgttcttgcgatagtttactgaaaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaataaacatacgtgtgcatgtgtctttacagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttgctgcataaatggccatactgcccaaggtaatttacagattcaatgccatccccatcaagctaccaatgcctttcttcacagaattggaaaaaactactttaaagttcatatggaaccaaaaaagagcccacatcgccaagccaatcctaagccaaaagaacaaagctggaggcatcacactacctgacttcaaactatactacaaggctacagtaaccaaacagcatggtactggtaccaaaacagagatatagtcaatggaacagaacagagccctcagaaataacgccgcgtatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgtatataatttttttaaaatagtcaattctgaggctctaaggaatgtaacaaaaacagaatgtatgaaaaaaagaatttgggttttatgttcctaaggctgaatcgtgtttctcaaccatttttacattattgtttcccttcacccaggacaattgtttgactttattcctctaataacctcctcttaccccccatgaaattttagtattagttattccatgtatacatttatattgtcagagttgagcttcggaggatcataaacaattataatatctaagattttttcacctcccccataaaccgatttttacgtccttggggatgatatcaccccctcctgctccctgattaaaatgcgtaagctgaaccagcactgaacttgaaaaaatatttcttacttttttacctcatgggccagatatgtgggagagttttcaaacttctgagaaaatcttagaatcagcacagatgttgatacagctttcttgaaagtcttgaaatatttttagccctgggaagatcatatccacgttgggaagctgtgttttcagtcttttgagcaagtataggaggaatctatctcctagtattctcattcccaaatgtgtctttggaaaatttacacattggtaatcagaatcagagtgatgtaaatttaatgattcctggaaaaacttttaaaaatgtcttttcactgtagattatttggaaaatatagataagcaaacaataaaagccaaattacccatggtctgaccaaggaggtgtgaacaacatattggcttatttctttactatttttccattttaaaaatgtgtatgtgagtgtgagggcatgtatccacatgcacatggaggttttttttttaaaaaatggaatattcagacatgttaatgtgtttgtattattagtattatcatacatattaatgtattattcatacatgctttgtaatgtatcttttacattttattgtaaacatttccccatggtttagagtattttcctacatcactatttctactggctatttagccttgatatatgtatataattaaacagtcccctattttttgacaggtaggattcttcacacttcttaccacaataaaaatgcttctataaagttcagtgtggctactctttgtacataccattagttattcccttaggaaatatatctagaagtgtaaatgctatctcaaaaattatgcacacttctactgatttgataaatattgttaaattatgcttcaggaaacttctatgagtcaacatttccaagttttctaattggttattatcacttctttttcttgctttatgtaagcaattctttacatatttctttgaagatagtaattatactaattattttatagtcctgttttatcagctctatttcctctggtataaactctttatttatttttattttttgagactgagtttcactcttgttgcccaggctagagtgcaatggcaagatctcagctcaccgcaacctccacctcctgggttcaagcaattatcctgcctcagcctcccgagtagctgggactacagtcatgcaccaccacactcggctaattttgtatttttagtagagacagcgtttctccatgttgctcaggctggtctcgaattcctgacctcgtgatcagcccgcctcagcctcccaaagtgctggaattacaggcatgagccactgttcctggccataaactctttcatctattagcctgaatggtgttggcattcagtgattatcagctccttgaataattttttaaatttcagcttatttttgaattctgggcacaggagattccctgaaagacttatgactgttttttcagttcactttacagagaggaaaaatgtctgacaggagattgctttggtcagtgagtgtgtggaagcaagtataatgcattctgattcttctctggtgttgccagctactcacggctccattttatttctctctgttcaaagcacatctcctaactaggctatagttgcgtaggatgtaggggaagagggtgagggataggaggaatagtgtggctatggggtagagtaggtagtctagtccacagagctgcttggtcctgagagagtatagtaatccctctgtctattgttccctgatcccattattctctgaaggactctactacctctgtgttttgaattgccttaattatttttggtaaaagctcttccttgggcttccatattcatcctggg

SEQ ID NO: 1195 - DNA, 32471 bp, Homo sapiens
gccactatcaccccataatcttcatcagcccttcaatctaccccaaattatctaatacaggcacacttcagagatagtgtgggtttggttccagaccactgaaataaagtaaacagcaataaagtaagttatgcaatttttttggtttcccagcgcatatggaatttatgtttatattctactatagtctattaggtgtataatagcattatgtctagaaatacaatgtaaataccttaatttaaaaatattacttaaaaaatgctagcaatcatctgagccttcaacaagttgtaatctttgcaggtggaggctcttgcctcagtgttgatggctgctgaatgatcagggtggtggttgctgaatgctgggatggatgtggcaatttcttaaaataagaaaacaagtttgacacatggattgactcttccttttatgaaagatttatctgtagcatgcaatgttgtttcatagcattttactcacagtagaacttctttcaaaatttgtatcagtcctctcaaaccctgccactgctttgtcaactaagtttatgtaatattctaaatccttttttgtcatttcaacattgttcatagcatcttcaccaggtatagtttccatctcaagaaactattttctttactcatccataagaagcaactcttcattggctcaagttttatcacaagattgcagtgattcagtcacgtatttaggctccacatcttcaggctccagttatcttgctgtttccaccacatctgcagacttcctccactgaagtgtttgaagctgtcaaagtcatctgtaagggctgaaatcaacttattccaaacttatgttcctgttgatgtttgaattttcttccatgaatcacaaatgttcctaatgatatttagaatggtaaatcctttccagaaggttttcagtgtcctttgcccagatccattggagtaatcactatctatgtcagctatgggcttacaaaatgtattttttaaataataagacttgaaagtcaaaattgctccttgattgatgggctacagaatggatgttatgttagcatgcaagaaaacaacattaacgtctttgtacatcttcatcagagctcttgggtgactgaatgcattgtaaatgagcagtaatgttttgaaaaaaatctttttttctgagcagtaggtctcaacaatgggcttaaaatattcattaaaccatgctgtaagcagatatgctgtcatccagactttgttgctccatttataaagcacagttagagtagatttaacatagttcttaaggaaccaaggatttttggaatgctcagtgggcactggcttcaatttaaaatcatcagctgcattagcccataacaagagagtcagcctgttctctgaagccttgaagccaggcattgacttcttccctctacctatgaaagtcctagatggtatcttcttccaatagaaggctgttttgtctagattgaaaatctgttagttagcgtagacacttttattaattgttttagctagatcttctggataacttgctgcatcagcactcgctgcttcactttttacttttgtgttatggagacagcttctttccttaatcctcatgaaccaacctctgctagcttccaacttttctcttccagcttcctcaccattctcagacttcatagaatagaagagagttagggtcttgctctggattaggctttggcttaaatgaatgttgtggcaggtttgatcttctatccagaccactcacactttctccgtatcagcagtaaagggctgtttcagtttcttatcattcgtgtgttcactggagtagcacttataatttccttcaggaacttttccttcgcattcacatcatgggtaactatttggtgcaagaggcctagcttttggcctctctcagcttttgatgtgcctttctcactaggcttaattatttctaacttttcatgtaaagtgagagatatgcaactcctcctttcacttgaacaactagaggccattatatagttattaagtggcctaatttcaatattgttgtgtctcagccaatcgaaaagcccaaggagaggaagagagatgggcaattgctggttggtggagcagtgagaacacacaatatttatcaattatgttctcctttttttatgggctttattggtggtgcccaaaacaattgcaatagtaacatcaaagatcactgatcagagatcactataacagatacaataataatgataaagttagaaatattgcaaaaattaccaaaattgtgacacagagacacaaagtaagcatatactgttggaaaaagtggtgctgatagtcttgctcaacacatggttgccacaaaccttcagtttgtaaaaaaaatgcagtatccgtggagcacagtaaagtaagctatgcctgtatttaaaaaaataaaataaaaaatagaataaaatcttaggttgaatattaataaaataatgtttagaaaacattagtatttttactgttgcataacaaaatatccaaataaaacttacatgttttatatgtgaatgccactttacataattcccttagctctgctttcaaagtactgttgctgcccaatgtcatatccccctccatccatttttctatatggaaattctggagcccccactgggttttaaaacaaaaaataggttaaaagttaattgcagtctcttaacattattattatgtcagtgcaatgctgagaacttgttggttgagtgatggtggcagctgttacacagtggtcatatggcagattgtaaccctgaggcctatccacaattcaaagctcatgtcattgccagctagtgtgataactcatacctggcatttttgtttactagtgcaaatggcactgacattttgtgaaaacattgtaaaaagtttgattcatttggtctatttgaaattaagacaggcttgatgagctctaggagcattcacaaatttaaatttataaatagagatgttaaagtattttatattactttgtgtcataccattcataatgtactcttccttaaaagaaagaggaaaagaaaggagatattaagttaagtgtgttaataggttataccagtgtttgcatgttagatagtcatgtggtttagcttgttacttggcatatgtggccccgattgtcacatgacaaggcacctgtggtgactgtcctttgttcacagctgcagcctcagctcatgccacagtacctgaaacctggtattttataaagatttgttgaatgaatgtatgggtaggtaaatgaatggatagttggatgcctgggtgtgtggatggatagaattttttttaaaaaacccaaaacttccttaagctgtagttagtcatctataacatggaaataataatacgtaactgataagattattatgtgaattaaaaacaataatgtatataaagtacttagcttgcatataagtgggaaataaattgtagcattaataaaaatatataattctggttctattaaataactaaatattttttgccaataattaaaactgactgcttttgtgagtctaagaaacagcagtgaacttggattacagttttatattctttgcgtctagaaagtgatgtttcatcacaaggcaagggctttcttctcatgacaaagagcctgatgtagctgcttaataactgttagtaacactgaaaggatctacagtaaatctgttagaaagctgtgatcaaaaatgtgagtgccaatcttcaaaagcccatttcaaagcttgtttgctataatactatgtagtggtttatttgcctttctttgtaactcattaaattaaaaatttggatccatcctcatggggttttcagaaatggttttataatttagcattccaatgacacttcttatttgcagattattatatactagtttttttgtcccactgtctcaccccagtgtagattattaagtccatatcattgcaatttgccaaaactctctggataaatgtctatgagagccaaggctccattttacttgtttatcgaatatggaattaatgaactatcttgaaacaatgtttataactaatgtttatatgacagaaaattggtgctgatcgtagtgtacatatgcaaactaatgctattttgttccccttgcctgaactctggctacacaggcagaattatattgctgttgtgttcaaacttcaaatacaatagtaactccagatgccatttttgtgttcttgtgaacttggagtgggtaaccaaaagcaaacaacaaaaacaaacaaaattgggacaggtgagaggcagtggcatggaagggagtgtaggcaggaaacaaataatatgatgactacaggatactacattctgatgaagactttacacttatggattgaacaactgttagaaaaagatcaaacatattatttgcacaggggtaatgattattttagaattacttcctgtcagtgataaatagctttatttaagcaaaatccaacctcttgaaattgttctccccttcagtgttatttttgtcattattttttcttcacttaaattacatataactgtaaagctctttgaaaaagtatattatctaaatgcatctatttaaattgaatgggtattaaatttattaaacatatttacaaaatataagtaagacatgaatttaatatgagtctgttgaatttttcattgtagttgaatgaatgaataatatattctagtcagccttttcattttctggtgcttctttttagcacccatagactttcatatattgtaaacattttcttctctatatctagttttagaaaataaaatgttgggaacacagaattgacttctggagactgggaagtatataactaaagtaatatgtgtttgctttttctaatttaattttgattgtggtgtgcttaatttataatcttttaaaatgttttaattttactcaaatagatctgtacatactttttatactcaattaacataattatttagctatcatacttccgtgtgtaagatttctagagcatcgccataatgtagcactttggtttgcaggagagaaattttcatggtacattatttacttgcattcaagtgaaaatattgttaatattggttgcatttgaaggattctttcaaaagtacgtggtgctcaagatggatttaaatggaacatgcaagagacagtaataacagagagatcacattctctctgtaatttattttaatgccattacacagggaattcaaggcagataaaaaactccatttacagaaaccaaatgtgcagaaatggattgtcataattccagatgaaatcaataatacatactccctggcatattttttattagaaataacttggaaaaatttatattttctactaagtaaatatataagttataagaaataacttatatattaaataaataagttataagaaataccatatattaaataaataagttataagaaataacttggaaaaatttatattttatactaagtaaatatacaatcatagccttaagatcttttgcagcattactttccccttgatgaattacaatgcaattttctagcctactcattttattaaggaagctaatgactggagcaaaagtctaatcagctgccaatcaggattccttgaagtgcagagtgtcaaatattgaagcaatttttacaactcataaaagcacttatgttccatggtatgtcataaaacttgtgatgaaaatctagcattgatgaagctaccttatttctcaagtgtttttccccaaacaaacagctttcaaatttcaccaaatctttcattaatattcaagtctattaatatagcactattatgttatctgttatagtattatattatccaactatagcaagataattagttatatataaacgtcagtcagagaacttagtggattcatcataaaagctgtaatggtggaatttttttttccatagtaaaaaaattggtctttcttctgataatgttagagtgggtttttgtttttatgttacagaaacaatgaggctgcacactttgctttcaccctttgcatcattatgtttgcattgtttatttttaacataatggtacattgtttcatgaaaagtaaccatatttcaaatcattaattcacttgtcatttatcattttaataccagaaagtagttaccttcctgtgtttgaaggtactgtataattgtatttctttaccatgtcgacttcctgtctcttaaaacgcagcaattacgtgtgtgtttgtgtgtttcttcatctgcttcatgcatataaatatgtgcgggtgtctggggttttgttgttagctgagaggtgggaagtgtttccacacatctgaatatttgctgccgaccttcttgatgatccgtctgttaatgtttttatcaagctggcacacctcatgtgggatcttaataaagtaatcagcattttccctctaaaacaagtttgagaaaatcctagttaaactattctcttcaacacttgaaggccttggttgtacagcaagcagctactaattcaggaggatttatttggcttttcctgagttctctgaaaaatctatttgtgtaaaaagaacatactgcatgatccccagggctcctggaactgaaaactcaaggatttagacgaagctacccagtttgtttaatcatttgaagttttgtttcagcagctcatgctttcctcttacattttggcagaggcagaaatctcagatgattgtttttgggtacacatgtaaaaattttctcattaaccttgggggtggtgtaatgataaaagagataacattttgtttcaaaaaaataatactaactgagcacatatttcaatgcattgcaaatctgaaggaattgtcatggctaacaccatctcagtctcagtatttgtgccccagttttttttcaggtcaagaatgtagggaaacactgtactaagttctcattggatcccttgatgcctcataagacacccagacccctagctctcaatttcatttctaaatgtaccccagctactagaatctctctcacaatgatgacaaacatcctctttaataggacagataaatattcctgtcactcttgactgagagacaatactccaggtctaggggacatgatctgcaaggaacttcccatgattcaggcaccactattcctgttcattttttttccattgtcccgggatttacagctttcaggagtaccttcatgttactcttctcataagagggcaacaccatatttttctcactgaatcagaagacccaacaccacctctttccccagagcactgccatttgcatcctatccagctaggtagggcaaaagtgtctttcattagactaaggacctccacaggcagtgcttaattttcatttacctttgcctccatagtgccttatatgtagtgcctaaatacggatggtgggtgactgcttagagtaataatagctaatatttttgtgacattagaaatggacacagtggtaatacaggtcaggattataactcaaaatcttggcaatgtgatgtttattggaacaaaggaacctaaagatcagaatgctttctctatgtaagatgactaggcctgtaaagtagagtgggtcactattctacagaaacacagatatcaatatttacattacaaataagatatattaggccattcatacaatttacaaaatggttcattataggactcactaactgaaagtacccaggtgacattgaacgtccagtttattttcaatataatcttcctgaaatctctgtattaatttggaaaaagtcaacaaagtaaaccattcttaatgtaacaactggatttaaactagggaggatcaaaatgtttaggtaacagaaactagcagtccaatgtggatctttctactttctctctttttgcctttgcctttgtctacgtctactttctctcctttgcctcttctttgtttatttaaacatatatatatatatatctatctatctcacatactcagaggtttattgcttagttttgttttttataaaaatggagtcatactatacacactactctgcaacttatttaagagtatactatgaatattcagttgggtcttattaaagatctaacatcctttttaattgctgcttaatattttgtactttataccattatgtatttaaccaagaatgtctttattaaataatataatcttcacctatgccagttaatctgttattcttagtgatttaagctcctttctctcatctggaaaatacagcaataaataggtaaaatccacagtttctccttcaagtgctacgtgcaataggcccatgaggtaacccctgaaattcatgttttcttggaagtaatcagcagacctggagtcctgtgtatgtttgtgaactccagaggtccacactccttcacttcacactcagtgtcctccatacttagggcttctacccccctgcccagttttgttaaagaaattactccttgggacatggacaaaataaaagaaatagccatttgtgtttctgtatccaacacttctttgtcctgtcatgggttcagttagttctaccatgaagtatggactgtctggtaagaggaaagagttttagagattaatgagggtagcactagtgaaactagtctcaaagatggcatagtcaatttcctcagatatagaccaatactgatatctaaaaagtttattcttatgggtagggatgtctggatgatagcaatttaagtcttcaagggagagcatctccgttgcttataggaacaatcatctggactaagtcatgaccacagttctaacagggaaagtaagcaagatccagctcccgaagaggagtttgcattggctgcaaaggggatccaagaccttagctcagtgagccaagcttcagggaaggactgcagttcccttagggacatagaatgctaacaaagaactggttttggagcttggtcatggggctggccatacatgttgggggctggcatgtttatatgacaaggtatttaggctttccacacctaaatattcagctatatctctgtaagtgcatagatccctaaagagtttgccctgggtacattgtgctggttgtcagataagaataccgaggctaataccagggccctccctttgttagaactctacatctaataaacacccaggcttggttctcattgagtcacaggctgggtggggctgagcctacaggttgaatattctcagttcttgactctggatccaggtggagtatgcatagactgataacaacttgtttttgcagtaagtctgaagattaaagcccttagttgagccaataccttccttctcagataagtcaaatccacatattcagaatgggagcaggaggcagaagggaaaattttgtaacctcttaacagttctagacttaacacatcctactatcaatctgagtggatttgttccagatgcttgcatggctgagatatgcaaaaaactgtctccccatgctgattggtagcatctttacatgggcaagtcttcctacttgtaaagaatgagttaggtgtgtctgggacttactaaggagtctcaggtgttgacagcttaaacaccttgccatgtaaatatgtctgatctctcttccagttcttacacagttggctgtggttactgacttcttattttgttcaggtctaaatgaaattgatcttgatctattactttaccctaggctggagaaacaactttagtaattatctcctcacccctacttcccttttgagctttgtaaaaatgattaaggagatcagaatatatggcataaattatcaatggttcttctccattggaggttagagttccactgtcaaaaattagtaattatcattcttcttacaagtttaagactcaaatggaactgactttttcagcctatttgttgtctatggtaaactaacagcaaacagctggatgttcttctgtggttacataaccttaatggagattagttccttttatccttctatactgcttccctaccaaatgattagattttttgaggggcagatataaaccccttccattgtttaaaaaacattgttaataacccttcgcactacacaccaaagtgcagcctttaatatagttgccagaagcagttctgagtgaaacactgaaatgaaaagtaaactcatgtcatttggtctatgataagcattcacagtttgaaaaaccccaaacagggatagttaagttgcaagcactatttccagaatgagagttgaaaattatatacataatgtggaaacaatagatcaatgaaagggagtatagaacaaaagagagaagaatttccatagccactccatagaatattaggtctatagaatgtcaagaggggttatgtccaaaacagggttctaggatcagataagtttggaaggtacagaattaaatgtcattaaatagatttacttcttgcagtattactcattatgcactgtgaatttccaagacagggacagcgtatgctgcatttcccaaacttgtatggtctgatgaatccaccgaagacagtgcttttatagggggacgtcatgatgccaaagagaaaagagcttaagaaaggagttcaacaggtcaagaagattagtgcataggaacttacagaggggaaattggtgcctccacagcattagttagaactagaccctgatataataggggaccagaagaaaggagggcatgaggaagagaggactgggctgcacatcctggctttgactggaacatatttcccaaatccttggtgatcaaagccaaagtaaatacaaccaaggttatataggagtaataagtgatggaggtagggagtcagctggatgaggcagagactggaaatccttgttttgacctcaagcctcaatcctgaaccatattgctatattgaaatatagtcaagaaatgaatgtatcatgcatagtggcatgtcaggaagttcaagtgtgagaaagccactttgttataggcccaattcctggaggaggatatatgcctctccagatccatttggcttcacttgtctccacagctgtggcaatcagttctgcatggactccaactatcttcctgtggggactgccgaccagtgtctcatcaaatcccattcccactgcggatttctgtgttggtgctacctggggaactcaggctgaggcagtgtctcacctaggtagcagcctctgtttcttgtttatttagagagtaattatgaattcataaactttcatattattacaaatcttactggagtatctagtaggggcttagttatatgctaaacagttgtagtttgaaaagccataataactctggttatttgacagatatcaaggcagggcaaagagatacccaactagggtaggtcatcccatcaatattttggaaacatatgattgcctcacattgtatatccttatcattgttttcttttaattattttacatataagtttagacagttgactgttgggaattcctattcagagatttatcttttaaccccaaatgattaacctgtaagctgtgactttcagtgttctggtattaacaataattttacacatttcaaaattatagtggaaagtaattttaccataatattttatctcatataacaagagcatggtatttcttttgtcgaactgcagcttttgtagataccatacacattattaatttcaaacatatcatttattccactagaattccattttttcttacctaatttatttccctttttaatactgagaaaaacagtatgagattgactattgaatttaataagatagtaacttaacacaataactaaaaacattggaagtttaaaaacaacagttttttcctaaacctgactcgaaaaccattgacattttagcaaacagatgggttttatgtaccacataatgaggtcctgggctcactcaagaccaccaggttgaaggaattctaaagctggagatcttttaaagatggcaaaatgactatgagattatctaaatatataattaaggaaaatagatcttttctgtttgtccttggtaaagtcctcaaggttgcatatgaccttccattaattttcttcagtcccaataggtgtttattttgccactgggaaagaattaggatttaggtaatgtctttgcctcacacttaggcttcctaacatgttataatgcactctatgttcatttcttgcctgtgttgcagtatagcaatatggtgaggactaaggtttagagtcaagcaattcaggatttccagtctctgccccatcatttattagccgtgtatacccttggttaagctgattaccctctctgagccttagctcatgaaatgagggccatataactcatatcactctgttgcccaggctggagtgcaatggcgtgatcatggctcactgcagcctcgacctcctggactcaagccatcctcccacctcagcctcccaagtagctgggactataggcattcaccaacatgtacagcaattttttttttttttttttttgagacggagtttcgctctgttgcccaggctggagtgcagtggcacaatcttggctcactgcaagctccgcctcccgggttcacgccattctcctgcgtcagcgtcctgagtagctgggactacaggcgcccgccaccaagcccggctaattttttgtatttttagtagagacggagtttcaccatgttagccaggatggtctcgatttcctgacctcgtgatcttcccgcctcggcctcccaaagtgctgggactgcaggcgtgagccaccaagcccggctgcaattttttttttttttttaagagatgagttctccttatgttgcccaggctggtttcacactccttgcctcaagtgattctcctgccttggcctcccaaagtgctgggattacaggcatgagccactgcaccttgcctactataaaccttaaatgatataacgtgttacagcagactgtgttaagagacctcatttgtacacctcaggtgttctttactgagaacacttcctattccttgcctttattctggctgcaggagcatggttggctcattccaaggcaaactggaagtctacaaaagtaatgcctcaaaaagcagtcccctatttagaatacctctgaggcatgttttacacgttttccagagttccccagcagaactgatgtccagtcgcccatagaagttgcttgcttgacagtacctctttccctttctttcctgaccgcatttctttgtccccttctagtaggtttcctgggatctcttttcaaataaattacttgtaccccaatttttgtctcacagtctacttctaagggaaaaataaggtgtgaaaagcacttagtattgtgtctggcacataatatattataataattattaatttcagaaacatatttaattcgttcttttttagaaaaagaaaccaaaagtgctatatttttgtaaaccactctcatggtagccacatcagttacagttatttttcattttctcttattgtttttaagaaatcattctttggctagtctcggtggctcacacctgtaatcccagcactttgggaggctgaggcggatggatcacctgaggtcaggagttcaagagcagcctggccaacatggtgaaacccagtctctgctaaagtacaaaaattagccgggtatggtggtgggtgcctgtaatcccagctacttgggaggctgaggcaggagaatctcttgaacctgggaggtggaggttgcagtgagccaaaatcgtgcctttgcactccaccctgggagatggagtgagactccatctcaaaaaaaaaaaaaaaatcattctttgaaaacttgttttctatttgaacagcaaaaccaggttcaacaagtgaatttgggcaatgactttacatgcactaatttttctgccttttaaaatacaattttctgacacctattttggtctggcagttcatctgaaaaataaaagcagaattttaaatgtgtaggtaagaaagattctattagtttccgacagcactgtagaaaaacaagagctctctatttcactaaaagcgctcagttccccctttttagcaaacactgaacattgatagtgtgttatgataaattaactacaatacctttggaggtcaagtgtctcagaaaaaagcaacagtaacatcttaggcaaaatggaaagcattagattcacacctgtaactcattaattttaaccaagagttagatttcacagaaagcaattactaggatggattgagttctttcatacacagggttgttttttttttaattgtaagactgttaaatattttctctgactatagttgccctcagcaatatccagaactagtggctatggattacttcattgtttctttctttggtaactgagaaaggtttaactatttattacaacgtttaaaaagttagattagaagaaaggatgcttccatctatttcatctttgtattctaaaagagtgtagctctactgtcagtggaataacagtgtgataaatgcactaattacatctgccatacaaagcttatatataaatccaaagtggacactgtgtgtgtgtgtgtgtgtgtgtgtgtgtgtgtgtgtgttttgagggtgtgcttgtgtgtgttcctgtctgagttttgcttctgtggttgttcatttgttaacagttatctgtttacaagctctttaaagatgaataacttagttattcaaacatgataaaatcgtgtttggtcgggtcttggtgttaaaatttacctgacctgactcttctcaaatgtctctctttacaaattccagtaactttattgctaagctataagaggaattttttagcttatttttgctttgagtctgtttttaactttctacaaataatttaatatcccttctctttgccttttcttaatgaagcagcatttctatgtgtctcctttcagggatgtatgtaaatgtagctatattgttgatagattaacataataatcaaatagaaattaacttcctgtgattcatcagtaaaactctatggacctacttttactcaaaattgttgctgtcaagcatttcaggtatgagttaattggctttctagaaaatgatagaggctatcctaaatctcaaagctcaatgatatctttttattttctgagatgccatttgtcaccatagcttattatacatgggctgattctcactccctggaaatagaaatgaagaaaggagctgtagggtcccctgccgccttctataaatgagcaaatcaaggaccagaatatctgtgggactcctccagaagctcttacagttacttacatagctaagtaagagcaaaggctggaagtagaacccacttttcccatagccaatccatttctcttttctaccaggtgtcttgtggcatttccccaggggactacatcttatctgctgtagtagaatcatgaaggtcatgaaatactggagctacaagagatttcggaggtctgctcccccccacccattttatacttcagaggaagaaactgagtacagagagttgggttgactaagaaattcatatagccaattggcgatctccttatagccattctaactttaaaaaggtggggattaaacctgctttcaaagcacaacctgaactgttccctcatccaagcttaagagagaatccatgacaccatataaaacagctctttatttccactggcaacaatggatgtatcctagttcatttgaacattttcctctctctatgatataggttagctggtttatttctatatccttgccaaaactggcagtgcatataggctgaaccatgcttgtggagaaaacactattcatatttcattatattaccttcagcagccctttactggcattatgactaaaacgcgtgtctccgagttgttgctggagaaatggccggccagtgaatttcgcgtcagaccagtgactattccagttgatatgaaagatgtcattactctgggggttatattgtggtcatcaggatattttctagtactcctggttcagaattttggagtattcatcttgaaaattgatgtctgtcctctattttggggggagattttctgtgtgctgtcttggctttctttgtttcctaggctataggtaagagttaagacgtacatgagtgtcttctagttaataaacctcactgccttctcacatggctgctgtacatacctgtcataacatgtatgtgatatactctctcccacacatacctatgcacacacagactcacacactctcacaagaagggaaatacataccattcttgccataatgttatttcatacatttgtgctttatttaacatttttcaatgcattagtattatgaactcttaaattaatgtaccaaagggcatttacataactttgaatatgttgattcaaaatcattacaaaatataatctaataagttacagagcctcattcaatgattccagttagcatccgcttctaagcgtgctattacttattcattagtagaagccctttaattttatattctgctcctggcagttgtggcttatttggtacttgttacagccactttagacaagtaaataaaaatcagatgaaaaatcctcagcaacagctggaaataaaccagtagtttctgtttgggtttggcagagtgaagcactgcagggctatgcatggaaaaataccagccagaactgttacacactgtgagaaaagattacatatctctagggttttggccttctaattactagggggtttctttgtccatgaagagtgccacctgcgtggttgggcaacaatataaaataattaaatcattatcacaagggtaatagtatacgtctttctggtttagctgtgataagaaaaccttaaacctgaaatacattaaacagtgtagaacatatgaaaagcctctttgagaggcttattcttgttgttatttaaaattttccttcactaatgtttagttcaaatacatgataattctagggaattacccgtctttatcagaccacccaaggaaggaagatgctctgccaataagtaaagccattggcctgtaagaacttgcttctgacttctaagtcacactcattttgataagcagatgtcttctaaaatgactgtgtggcttagcatactgagctgtttttctttccttttccaagacagtatggacatagttaaaaaaaaaaaaaaaagacgaaagattgttaagtacctgataatttcaataacatatttgtagtaactgcattgcagttaagccttatttaaagtaaattatctattttgcatccttttttttcaataaacagtttcacttctaagatgatgagggaaaaaagatgattaaggtttagcaatcttgttgcaagcttatttaaaattagttgtttaattatctacttcagatattattttgccaactggttatgttcatgccctgattaattattcttttcttccaagttatactcattttggaaaaatcaggtttagccatagcatgtgaagcccttaaaattgtctggagacagatatcttgatctcagaaacttaaattatcttaatactttctggagtaagaccaggaatggaagaagaagagagaaatatttctttatttttcctaattttatttcttctttcagcagaggaactgtactcttaaaattagagggtcagagcccttgctctgctgctgaatttatctcttacttgaggaattaggcacaatctaaacccagtactatttatttctccctttagaaattgaggaagttacctatggctaatatttttcaaatttatgtattttgtttgtttgtttgtttttttgggagatggagtctcactctgtcacccaggctggagtgcagtggcacaatctcggcccactgcaacctccgcctaccaggttcaagcaattctcctggctcagcctcctcagtagctgggaatacaggcacatgctgccatgcccggcaagttttttgtattttagtagagatggtctttcaccgtgttgccccggctggtctcaaactcctgagctcaggcaaaccacatgcctcggcctcccagagtgtgggattacaggcatgagccacattgcctggcctcaaatctacattttaaaaatattttaaaatagcgattttcaaacattaatatgatcagaatcacctgcagggcttgccaaactctagactgttggattccacctctagagtttctgattcggtaggtctgggatggatctcccaaatttgctttctaaaaagttcccaagagatgcggttgttgctagttcctgagatcacactgtgggaaccaaagccttacaataactagcctttttcatgagagaatggtaaggaaatataccacatatcaagagaagttatctcttgggttatcggaatgttagtaattttgtacttacccttttttcctctattctccatatgtcctacaagttatgtataatacatatatgattagaaaaaataatgaatgtttttggaagaacacttgttgaactagaaattcattaatctctattcattcttcccttctgatgtcttgtagcaatataataatgtcagttctcctcacctgctggggacagacactcctttcgatgtcttttgagggagctttcactcagcaaccaccagacagttgcttggttccttttagagtgctgtctttattgtgccagaatttagtacaagaggtgctggctctccaagatgagcaaatcccttaattgtatttcaaaaattctccccagttttttttctctctaccctcctcaggttacaatgctaaaagttctgtgtgggcctaaacactagtgggaaaaagcgcctggtgaacaaatgctgggtggcatgcccactcagacataaagaagttctgctcacccttttgggagtgtactcatttttgagaaatttgcctcacttagagctccttaaaataaatcaaacaaaattatatataaaatatatgctttcacaatttcagccatttcttttggtgtttctcttctaataaccttctaaacgttgttgctttatgtttttatctcagatttttgaaaacaaactaaatatagcaccctaaaaaacctttcaaatattttggattcttttatttatgactcttacaagcatgtgagggggcttgtttagagagaataaaggttataacctggtctgtctgttgagacagtgattttaatcacatttaattcccattcactctgtatgttacttgatccactcattggtttaaaagcatattgataaatacagccatggcttagcctcttgcccttcatcccgtctagagttgcatccaggcttaagtgagtttgccacatttagatgtcatactttgttactgatgagatccttgctagatagtggagcctatgtttttctagagaaaagtccatattccattataaagataaataaataatttgtttcagaaggctttcaagatgttggcttatagtcaaactataagtaacagcttgaaaaacctcagtgcttctcacatacatgttaatggctgttctccttcataaatactttgaagtgtttcagtaaatattttcctaaagaactttaacttatttgctaacttattgagtatcaaaatgtatgttgtatatgacactatgctaggcatatatatacaatattatccataatttttctaaatttttttgcaaatcagataaatttttattttaagattcagggggtacataagtaattgttacatgagtgtattgtgtgatgctgaggtttgggcttctaatgatcccatcacccaagtagcgaacatagaacctgataggtaatttttcaacccttgtcaccagccctcgatttctccctcctctttttggaatccccagtgtttattgtccccatctttctgtctatgcatacccagtgtttagctcccacttataagtgagaacgtgcgatttttggttttctcttcctgcattaattgacgtagtgtaatggcctccagttgcatccatgttgctgcaaaggacatgattttgttcttttttttaatggctgtgtagtattccatggtacatatgtaccacatttcctttatctaatctaccattgatgggcactgggttgattctgtctttgctattgtgaatagtgctggggtaaaaatacaagtgcaggtatgcttttgggagaacaattcattttcctgtgggtatatactcagtaatgggattgctgagtcaactggtaattctgtttctagttctttgagagatctccaaatggctttctacaggggctgaactaatttgcactccagccaccagtgtgtaagtgttctgttttctctgcaatcttgtcaacatccatgattttctgactttttattactagccattctgactggtgtgagatcctatctcgttgtggttttgatttgcatctctcgacatttagtgattttgagcgttttttcatatgtttgtttgccacttatatgtctccttttcagaactgtctgttcatgtccttggcccactttgtaatggggttatttgtttttttcttattgagttgtttaagttccttatggattctggatattagacctttatcacatgcatactttgcaaatattttctcccattctataggttgtctgtttactgtgttgatagtttcttttgctctgcagaagctctgtagtttaattaggtctcaattgtcaattttcggttttgttgcatttgcttttgaagatttatcataaatcccttgctgaggccaaggtctagaagggtttttcctaggttttcttctaggtagagcaaaactttaaatacacatttaaaaaatatattttcttcagaaaccaggatgcaaaagaaatttccaatattcctatattttattaataaatgtatgaatttgagcaatgaaagaaaacatctcaattcttttcaaaaaacacattttccttctttttggtgttgtaataatatgctcccaagtgacatggaagtgactacttctactggtcatcagtggtaggatgggagggtaccaaatctggcagcaaagaagtttacaaatcatattgtaaaaaataagcaattgtgagaaacggttattgcaataagttccagaaatcattatggacttccataaatcattaaactccatagcaaacttaagtacattttagttggattggattctggttcagaaagctaaaaaggacattgctgggacaattggcaaagttctaaaaagaactaaaaaaagatgatagaactgtaccaacatccgtggaacagaatagagaacccagtaataaggccacacacctacaacaatctgatcttcaacaaacctgacaataacacacagtagggaaagaatttatttaataaatggtgctgcgataactggctagccatatgcagaagattgaaattggaccccttcctttcaccatatacaaaaattaactcaaaatggattagagacttcaatgtaaaacccaaaactgtaaaaaccctggaggaaaacctaggcaataccattttggacatagaaacaggaaaatattttatgacgaagacatcaaaagcaattgcaacaaaagcaacacttgacaaatgtgagctaattaaactaaaggccttctgtacagcaaaggaaactgtcaacagaatgaacagacaacctacagaatgggagaaaatgtttgcaaactatgcatctgacaaaggtctaataatcagcatctataaggaacttaaacaaatttacaagggaaaaacaaccccattacaaattaggcaaaggacatgaacagacacttttcagaagaagacatacatctgaacaacaatcatatgaataaaagctcaacaatactgatcattagagacatacaaatgaaaaccacaatgagataccatctcacaccagtcagaatggatattattaaaaagtcaaaatacaacagatgctggcaagattgtggagaaatacactgttgatgagagtgtagatagtgtagattattttaaccattgtggaagatggtgtggtgattcctcaaagacctaaaaacagaaataccatttgacccagcaatcccattactgggcatatactcaaaggaatataaatcattcttttatgaagacacatgcacacatatgttcattacactactattcataatagcaaacacatggaatcaacctaaatgcccatcagtggtagactcgataaagaaaatgtggtatatatataccatggaatactatgcagccataaaaagaatgggaccatgttctttgtaggacagggatggaggtggaagccattatccttagcaaactaacacaggaacagaaaaccaaatgccacaggttctgacttctaagtgggagctaaatgataagaacacatggatacatgggggaacaacacacacaggggcttattggagggtggagggtgggaggagggaaaggatcaggaaaaataatgaatggatactaggcttaatatctggatgatgaaataatctgtacaacaaacccctctgacataggtttacctatataacaaacctgcacatgtacccctgaacttaaatgttaaatgaaaacataataaaaataaaacagggatgtatacacacacacacacacacacacacacacacacacacatgcacacatatatatatataaaatgatgtgcatatataatggtcatatatatatgaggtaaaatattaacaattgagaaatctggatgaaggagatatggagatataggagttctttatactggctttgcaaattttttaaaagtttgaaagtattttaaaaataaattatgtaaagggatcataccatatgtagttacgcattaattgtcacaatgtttctctgattatttacatcatggcatttagctttacagttaaactatttgtacaaactcttggtcatataacattctgagaagacaattaattttggctttgaataaataaaacactagaagaattgttttctccttaccactttgtgtcttatggccattaacaaaaaatactgatagattgactttactttttatgactcttttagttttctagttctagaacgtatattacaattttaagatctaattaaagcactttatcgcatacagtattgtctctttttttcactgttgaacaacatatttttaattttgaaattcttcttttccattactaatggtaagaattagatgattgttggttttacaaaaatcacaatagatggaaaagaaaacactgtattttctcacatgtgcatcaaataccagggttttggctcataaatcagaagagcacaaaaagatacaactggagtccttcctagttccactgttacagccaaaatgctgacattcaggcatatttccaagacccacgtttcggtaagcccttatgtgcttcgagtgggctgaaaagaatgtgaaataatttcacatggcaccttttacagaaggctgtgtgaggaacacaacattctctttgaaagagaaagtcatctttgtaataataaccattggttgctttcttttttttaggcatgtaataacattagaagatttactttggaacttgtttggaccattatcaacacgttagttttggtgacaaaatttgcatttactactgtagagctgtaatacctgaaagatgcaccatcctgacttgggactaagagcagctctcaacctcttttattcccctcaaaaccaacaccagtgcacaagtacctctgatattagataaaataatgaagctcacagtaattataatgcctattattttatcagcatctaccacgttctaagtgccttacattcttgatccaaactaatcttcaaaaccatccttaaagaaaaaaacttttcatgttacaaataaggaaactgaggcccaaaagagctaagcagcttgcctagcatcaaaatagtattgatggacaagaaattcacctgttctatgtcactctggaacctgtgcttttttcacaaaacctgtctgaagttagaggggtaacaaatggttactagcatggctaagagaagttacatgtggacagcactcggatttcaactagttggcagattatgcttgcttcagtggggtgggaaaactgacaaatcctctgacattagggcaaagaactttgttagatgtcatcattattacaggtgactctgatgccattttattaaaggctgtatcttctttctgtttctatctacaatgcttagtggtacacaacgcatgacaggtgcctaggaagtctttgttaaataaaagagtgaatgaaatatgtaatagagtaacttattgaatggcagcttaatggccttagtgaccagaattaactggtcaagagttaggggggtattgccagttaagatttcaagaacagttttttttttttaactgcagtatgggtgaagaagggtgaagtagaaaagtttacaaagaattaagaactgattttgaaaaatgataagccctgacctaatgaattacattttaaagcattctttagttatggaataggaatatataaaagcagtgattatcttcttttttcttcactgtttccaattggttgtattttttttttctctcctcagctggaaatgcctaggttccacagttacaatgtctgctgattttatattacttaagtcttgtagttttttcctttaattgtgaagccattcttacctaagttcaatcatattggaataattttcatactcctaaattagtatattagaattttttttcctcaacctatctttactagcataattaacttacatatatccatcctttagatttcgttttcttccacagtcactggaaggtggttcaaattctccagggcacttttatcttcccattcaaaacatgtccatttacattctccctggattgtgaagcattatgcactccatatgaatgtggaggcaccattttcttctgcctcctagtaataaactgctgtttttcatcagttttaatatttactttcaacagaaactgtcaagattgccattatactatttgctaataggaggcctgccctttttaaatatgctttttaaaaaaacccagattccttttctacagggccgaaattaaagcaggttatgaccatggcccgtgaggcatggttttatgactctgctgaaatctcagcctcctgctcctccccttgagggataagaagcaaatatgctttggtaagattgatgaagcaatgatatccccaagtatattcctattaagttccggtttcacagaacttacaacagggtaaaacccccaaataataactttctccagatatttatgatacatagtttataaattattacctagcaaaaatactcttgtatacaaataatcagtattttcttcaaagagagcatatttctggattaatttctgaaaacattcttagcagggaagtttccagaaagttggggactttctgtatcccttgacttttgatttctgtgcgacagagctcagtagtaaattgtccttaccatccctcatttaccttctaaggtactgagtcattgtagaatatttttaacatcttgtgtttccagacattgcttcatttgcaaacttaagaacatttaaatatttaagagtatttattttttaaaacagagatttcatacaagtgacacagctaagtccaaacactgtattatttatgtccccagcgcttgactttttgagtttcttttcttaatatttcagttctagagatttcatgtgatatactagataccaattactaaagtgttgttcagagagcagagggttaaaatgttttcttagtgaattctttaaaaactgtagctgtggaagcaggattgctcttgtttcatcctgacaggaatggtagatttaataggttccccagagctttttatcgcattataactctttctgtgatggtcagttttgggtccacattatgtgacctgactttcaacttgtttgaactgctgtcaggctgcagaggaactgaaggctactagatagtcctgtagttttccagttgggaaaacaacaatcctgcctgaaaacttctgacaagatccaatactgttcttcttatagcaaaactgagtcagcctgatacctggaaaaatctttacctgctcaaagtaaagcagtgtggccagaatgccttatcgtaatgtaaatctgtgttgctttgctctataataacagcttgtctatctcttgtgatcattcattccctgaggttgaaactattatcatgtcagcagagctcccttctcagttagcttgcattgctagccagcactcctgtataaatcttgatgtctcctaaatgttctccctagatccagtgtgtggtatttaaattaaggaagctcagacatgtcttgaaaggaactgaagtattgcatttagtcttgccaatccactgattaaaattcttgccaagtgttacattatgcacagcttccttattttggctgtaaatttcattgcatatttttctaggatgagaaagtttgtactttttatttcataagcccacataataaacacagctttcttcaaaaccgtttgaggtgttggatgcgtgtgctgtgttaaatatagggctcctttgtggaggaaagcacatgtggctcattttaacttcacacacaagcattttagacggggcaaaatggttctgctgggtaaaaagaaaatagacatttcgatgagctgcaggattatccaagccatagctttatcctctctgaaatctcttctatgcacttgaagaatgaacaaaactttctttatggacacagaagaacccactctcttctctcctatagccactgccactcattctgcccctgtattttaaatttttagtgggtgagtatgtgaatcgaaagctctcagagctggggggtggtggctcacacctatgatcctagcactttggaaggccaaggcaggcagatctcttgagttcaagaccagcctgggcaacatggcaagaccctgtatctacaaaaaatacaaatatttgctgggcatcatggtgccctcctatagtcctagctacttgctactcggggactgaggcaggaggatgacttgacctcaggagtttgaggctgcagtgagctatgattgcaccactacactttagcctgggcaacagagtgagaccctgtctcttaaaaaaaaaaaaggctctcacttttcactaaataaatgcttctctagcataaaactttgtgtagcgtcctttcagctaccattctgaagagaaaaccccaatgtcttagagagggaacaaatagatttagagggagattagcagaagccataaaatgcatactttggacccaatgactgggcctgcatttggaataaggggtagaaaactggataattcgctccatttacttctgtaaatgtatttttctttggtagcagccttgcaggagaagggcatctttgaaggtctggaggtggggctccactgacattcaaataacgcaggcctagggtacagggactgaaagctcactgcacttttgattcggattgggatcctcccataggttccattggcaaatgactactttcttaacaaaaagaaatagttctataattaatttttcttaaggaaaatcatatctcaacctattaatttagaaatattttaaatgagtacatggggatacaaatttagttatacaaatcacatgtgacactgttcatgctgttcgtatttcagtatagattaaaattttttaatgctaaaaagagcttttcttgctcttagagttttttttcatgcacatttccatgaaaatttagaagttatgagggcaaaatcttcatctatacacaaacacttttttttaaacaaaaaggagtaaaatttcatcaacattatgaactatgagccctattgaataattttttcctgtaaaaaacagaatcaagttatgaaatgaagaaaataattaggtctttgctaaaacttagtctttattaagcccaactttttcttaatcagaaaaagatgtcaaaaggaataattgtattgcttgacaaagtgatcaagatgttttctgctcctaagttatttcttcatgtgacaatcattccttaaagctcctcttaataaataatggaaagaaagaaagttgatgtttggattggggcaataaatgtcatctttatgtgtgtagtttggagaaacgggcttcttgtttgccatctcctctccagagttacagatacagtgtcattggtccttttaaaagtatggaaagcagagtgaatggcaaaaggtttgccaaaacagattatcttttgtatgcgtcaagattttatatttttgcaaatatacatacacagacaggcttttcaaaaccattttccttcagacatccaagtaaaagttcagagtgatttcttttttgctccttaatatttttaatcctttatcatcttacctaaagccatttagtatttcctggagcagatggggtataagccataaaatgacatatttacttctttgtaggaagaaaattaggagaagagattctataacacgattgaagtttaaaagctaaattccttgaggaaagattatctttctccatagatctcattctctgataaaacaaatgaggttgtctcagaggcacctgttaatattgacctacatcatccctagttctgaccttgtgtccccagccactgggaagtttttggtagaaaaggaactattaagttggttcgtttcttatttcttggaaagagaaaggtctccctccccttgcacttctgcttgatctggtctctgaaggagacttccacagaaacaagggcacaatctgtgccttgcaactacgcctatcatttcctctttacttaaggtcaaaatttccattactgcttagactctattaataatgggtttgaagattattttggggaattattccttcaaggaatatagtgttaggacctgcgccttgagaagggtctctgcctggatggaggaacgaggatgctcttgagaaagaactgaattgtgaattttttcttttcaagtaaatttcccagttgttttaaaaaaaggtatgttgccgagcttttgaggaactcttcagaataccagagatgtcttcaatttaataacatcttacagcaccgttttcaccagctagtatatcctttgcctgaaaatccctgtcatctacgatgatgaatttactcctcattcagactgtctctctgaaataccagaaaaatatgatcttcattctcctctctggaccctttagtagtacctaacatgagtaaattcagcctcattgttgatggaaatatcccttcctggtgaaaactgacagaatctaagcaatcttaaggtcccatggctaccagtctggcacattctaggtttttccagctgccatttcttctttagtggtgtggtcagttctcctctggccccttcagtgaactgtttggggttttacccactctggcattgtctttacaatgtttcgtcagatcagaatttcccagtaatttaacacttctgtaatgaccaaagagaaatttcttatccagaatgtcaaggaatatgtctcagataaatgagatgtatgcctacaacatttcaaaatggcatcaggcttcaagttacagaaacaccatccacatcctaggtagtgacttacacaaaacacaaagtcattttttaaagaaaacaactgttttctctcattgaatgagaagtagttcagggctaatgtgactccttcacagatgatgtcagagattgagacacctcccaactgttctttctaccacaccatagtgtagtcagcacgcccatgttgactagatggctgctgaagtcttacccccatgtggttagtcttaggcaggaaggtggatgagtaggaaatcaataataataaataataaataaataacaaagatctgctatggaagtaagccctctgtaataagcttgcctggaagccccacctaatggcatccacctccatctaaattggtcactcatctctttttcatctttgaaagagatgctgataaatgtacattctaaattgggcatatagcctgcccactaatatagggattctgttaccagggaaaatgagaattgatagtgggtaggcaaccaccaatctatgtcataatgacattttctttgatttagaatttctttttaaattgggatcatgcgtatgtggaagaaaatgcatgaactaggtcttaaaatattttgtttactatgaatttagcatctgaaaaatacatctttaacatactctgggcaggattttaatgagcttgacttttttgctctcagacctaatgatgagatataggtcattgtttcatatttttccaagagattttaagggtctactgtaaacatttatgagaaacattttttttctcatttgctatttcaagttcagaaagaggaatgaaagtcactgtttcttgggtatctgcatattatttagatcttagagtctaggagagagaagcatctcttggtttttaaagatcagtccctacgtttttggatttgagatgaagaatgctagtgtgtgatctgtaactaaaaactgctccagtttcctgatgtgtaaatatttattctattatacttatcatcttctcctaggatcacggcccaaatctcatcttcaaattgaccaacaagatgaggaggttcataacaagttattttttaagtcagcccaaggcaggctcaaataaattaaccaaattcctcacatctgtgaagcttcaagatgtggatctccttgtcattgcattgtattttcttagagatgtttcttctgctccctaaaggaaacactgatgctattcagtacctgacacatgaatctttcatgcaggctataggtgacctctaatggaatccactttttacctgattacttcagctatattgtttttcctccccaaggggttaggacagctatttaaccttattgttttgtgtcttcctttgagagtggcttcttgctttgtatcccttctgatgaggatgatgatgatgatgaatatctgtgtaacaaaccacttccaaagtttagtgacttaaaacaacagctatttaattattgattctatgggttcactgtaaagctggacagttctttttctgttatctggcctcactcatatgtctggtcagttgccaggaaagctgaatgctggctagtctaagttggcctccgctgagatggcttaatcctgttccatataatctctcatccttcagctagctgatctggactagttcacatgggagctaagcagagttctaagagagtgagcagaaatgtgaaaggcctcttgagacttaggacgagtactggcacagagtcacttttgcctcattctattgaccaaagcaagtcatgagattagcctagattcaagtggtagggaaacagattgtatctcttgatggcaggagctgcagagtcatatggccaagggcatggatacaaagaaagaagtaattgctgcaacctttatgaaaggtctaccacattaagattcttcgagcacttattcaggcactgtatgagctaagcactgtacatgttatctcattcaattctcataagaactctacaaggttgatactaatattatacccattacatagatgcaaaaattctaagcgacagagactggcattttgattttaaagcccttttaattaccagatctgtggactccaaatgttcttgattgtatagttctctcagtacaaatattttgaacatgtacttatatgtatgtgtatgtttgcttataaattacatacaagtactactgtcatctatatattaaatattaataaacttgaacttcattcttatctttttagataaaaattataaatatcaactaaagtttcagtgcattttttcatcctttatatgaatgtcttgtagcctcactttggagaccatgcatcaagcggc

SEQ ID NO: 1196 - DNA, 147230 bp, Homo sapiens
tcctgaaaacaactaatttcacaaaaaatctgagttgctacctggaattcctaatgtgaagagcaatgtgtttaaagggctttttgagtgtgtttaagagggaatgatttcataaattttgtcttaagcattcacaagcagagtggagcgccctctcacctccctccacatacacaacggctttcccagcatatatcactccagcgctcaacatcctgcagtgattctgtttcgctcttgttaaacctccagatgtggctgggcttcaggcatgctgggaggaatctaggatagcagtcagcagggagggactgaggcagtttacagagggtagagtgttgggggttacccctcaggagagtcagtcaagcatggctagtagtgactttgccagctggcctgtgctcagcaggggaggggccccagccatgggcctggggaacagcaacagcctttcagtcctgagagagcagcatggcaggagaaactcaggggctctggcctttttactcaggcagggagcagagatgcaggaaaggatgtgatgctaggccacagaaaatagggtttaaatcttaactgcctcggccaggcacggtggctcatgcctgtaatttcagtacttcgggaggccagggtaggaggattatttgagaccaggagtttgagaccagcttgggcaacatactgacacctcatctctacaaaaaataatcaaaaattagccaggtgaggttgtgcatgcctgtggtcccagctacttggaagactgaggtgggaggatcgcttgagctctggacgttgaggctgcagtgagccgtgatcacaccactgcactccagcctggccatcagagtgagaccctgtctcttaaaaaaaaaatcctgactgccttaggtgggattgatcctgggcactgtgggcggataagcctgctaaaggaggccaggaggcccagatatgaggaagaagagggaaggtggttagggaccaggagccaggccaggtctgacaatgctgagttacacactgagccaacctacctttgccctccctccttccctcctccccgtcttctgtcctccctccctcctgcctcccttccttctttgctttcttccttcctttccctgtttccctccttccttccttcttttctttttgtctttctcagtcaacagcaactattgattacttcttgtatactagccttgaaatcagtgtaggtaagattcttagaactaagtgcagccagaggcataagtacttatttacacattaatattttaagaactaaataggttcttcaagcagggaaaatgaaacagaacaaaggaagtcaacagcttatagtggtcagggaaggcttcccagaagaggtgacatgggagcagtcttgaatgatgagtagtagttttcaggaagcagaaggtcatgatctattcagatgtatttcctactctttgctgtagagatcttgctctgccatctcctcactgttctgccatcatatcatccaggtcttggttaagctgttttctttgacagtcccagcatgccacttaaaatggagtgaaaagtgttagggcagaactgaagagaggaactctggtgctggtgatgtgggtagcaaacctccatcagagcaacctgggcaaagtctggtggtcatcgccagtgcgagctcctccccgctttactttctcttgtgattacctcacctgcttctcagtctagggaccatctctacagctgctcactccagttggatttctagtatgtgttttcttcattccacatgaacttgtctagttctttctcttaaaagtttaacttagccctgattgctctaatcttgcctgctttttgtcattaagccttccagatgctcttcgtggtagaggaaggtgaggtggggagggttcaaaatccaagccatgcatctgccttgaactcttctattgtaatggcaattccaaggacataatttgtttattacacttctaactttggttactgtgatcccttcattctaaaactaaacttcaaagttattcatcatgtttactacacatgctcccacttctaagtgaacctccctgttgaaagggcaaccctatgcagattaaatgctccttctcattgtagccatacctgaacctggaagtgtgtattccccaattaaggcagaaatttcctgagagtgagtaatttcatattcatctttatagccctggcttattctatcacatatagtaggtgctttgagatattactgtctctcatcccggattctcaacatgtttatatagttcggttttgaccagtttactttggaaagttaatctctttatcttcaagtgatttctaaatgaaaaaaaaaaacaaaaacccaaacttcagaaatgcttttaacaggcaacctgaggattatattcatatttatacagtaattatttttatcatagtattatcttttatttttaaaaagtttgtatagccaggatctcataattttctttaaatatatttactttaaatgggcaataaagagaacaatatgtaattgaatagatggggaatgaaatacagagaatttacattctacagatcacatggaaagagggaaagcctattgtttcattcatgttttaccatattgagggtatttaaccagttatatcattctcctttttcatagtttgattttaatttattaataatttgtcttttacatactacaggtaacttgtcattgacatcatattactaatatgtatactagtgttatcctacaatacgtttctatttttttttttagcttcaataatatagaaaaattgtatgtgttggtgttcttaactggatactcttttaaggtcacttgtttccattttacttttgatttttagagtttgcgtttttaaaatgagttttataattggtatgtattatttatatttgtatgtttcataattaactctttttaaaaaaatagaggtttagtcattctttcagaaaatgttgagattagcaaatcatgctcaaagataggaattaaaggttgtaaagaaaaagaaataaaaataatggaagccctcttttcagatgtggaaatacgttggtaaaaattctaggctcttataagttctctcactgtgttgggctagctaaatgatacctaaatggttggaagttcagataatatctataaacaaatattttaaagttaggaagtactctaacaggtgccaggatatgtctacatatcttcctaattacatagtagctatagtataatgcttgtgtagcttatctacttgcgttaaaggtaaaatctttttaaaactataaaaaagagaagtttattgagttcccgatttaaatatctctcatccccaaagaatctctgaatgtgacttgttggtacacagtaggaaacaagtttcaagcaaaatactgcaggtcaagcctgttatgttttgggatgactacattatattccttcagtttatggcacagaattgtttttttaactgtatctgatgtagctccacagtaatacaaggtggggcaatttcttagggagccacttttataatcttttttgtttttggcactgttaagaatcctcttcttcatttacccctcaaactgaagatactgtagggatgaatgaatctggccagttcttgatggcaacaaattcaagatctccagggtcctgtcacaggcactgtgggtccctcgggttacatgatcccttattgctgcagctctctttggtcaaaagtcattatttttttaatgagttaggacaaatttattgttttgtatactagtttcctgttctaaaatgatggttataatggtacctaactactttacaggtgtggaataactaattgcccactgtaaaatgttgttgaactacaaagtgttagataaatgagtatcactctacttgtcattattattaatattatagtgcaaatctgaaagatgaaagttgctggataattgcaagatatggtgatggtgtatccaaataaaggggaataacctgaattgttggataacacaaatccagatatctgtgtgtagtagaagagtttgttttacaaaaagattatatagatagctgtgctttaattaacccctcaaaaatctgaggatttttcctacaaatatggatagaggaatattctaacagtagttcatttcatcggtatgtatagtggtcatcataaggaagcgtctttcaagtatttaattgcccagagtaaaaaataattatatactagagtatgaggaattccagcttcatgcaacattaccagtctaggagaaggtgagcttaatgtagtcttcaggacaggacacgtgatgaggccatctcttaaggtatgtgaaaagaagccagaagcagtagcatttttctattcaggcacatgcttggcactggggaggaacaagggatcccacagaatagagttaatggcccacccatgtgtatgtccagcaggcagtcaggcctggaaaaagaagtagggaaagaaaaacctagcagaagcttagagtacacaagggaagggtggtgctgcaatctggaaggtgacagggaagaccaggtatcctcatggggacacctgaccctgagtttaaatggcagcaggagagacctggcaatagtctggagccctctgaggtcagtatatagaccccaggtctgaaagggtgacccaagtcagattagctaagagaaggttgaggctgctagagaatctgagtctccaaaactggctttgagagtggggctgaatggagcttatgcatggggagaatcagtggattcagctatgaacaactgggagagagatgcaagaagactcagaagtgtacaatattgggacgttctccaggagaagatgaacaagaagtgatgtctgaggagttgtagctaaaatactctctcagcttctgccacatggttatttctgaccaacaaaaagctctcagaaatagccatgaggggcacaaagccctcactaggctaaaaatccactaactctgcaacttcctagatgctgaacacaccaaaggcctcacacttacaaatgtggtatgatgtccatgcctgcagggtcagctttgcagaacagaccaaaaagacttttacaaagctccaggtttcatttctagcatgattggaaaaagcataattttctagtcagattttgttaaacaaggaataattctacatctccattagtacaaaagccttgctctgtcattagattatctctacttaagaatcttctagcaggcctctctgcatgccctggatggttgggcactatccctactgtgtctccatcaaagtcagtgcattttcttaggtaactatctctctttcctctaagattatagatttcacaatgacatggactgtttctattgtgttcacttgctgaaacctcagaatcttgtagaaaatttgacatataataggcacctaccaactagctgttggacagatggctaaagaaataatggtaataactaacgtttatggggtgctgatctgtgccaggcactgtgtaagaattgcacatacattatctatgttaattatctcaatattctgagtagatagatattattattcttctcattttacagatggaagatcaaaagctcagtgaggttaggatgaataaaatattgggcagacccagtatttaagcaaagactctctccaactccaaatcccccttttaatcattgtactgtaagttcacgagttcaaattaacttagtattacttatgggaataaggagtatattcatggatttatatgtctctaaaccttcttattctgattttttctgggcaacagattttcttctttgaatttccaactcatccttatgtctaattctcatcctctggaaatagctttacccctcagagttatttcctgggaatagaagaatcagtggtgctaagctaggaatttctaggcttgtctctccttctttctcagtttgaatatgatacagtatccgttatttaaccttaattctgataaaatagtattttcaataatcagaaattctgaggatcttgttgtatttataaataacagaaataaactataaagaagtcctctttgacttttctcaattccatttttctttcacacagacaatcattattcggtgtacaactttttatttgtcatagttttatatacatatgtatctgcaaataacaggcaatattgtttaaaaatgttgcataaatatattatgggcattctaaaatttgtttttattttattattttgctaagcattgtttaaaaatgtattcatgtagatatagaaaccactaattacaaaatgattactctaaggatactttcagtttaattgagaatggctttatgcctataaaattcagttctgtttttgaaaagtagcttttaggaacatatgtaccagttatacaagaatatatcttcatagtcctggtacagctagtctttctaatgaagatgataaaagttggaaaatttgaagtatgtacagtatatagctttggaaggcagcagcagtactaaatttcaactcccacaagtttagatgtgccagggtagtatatctggataatatttagattggtgctcttaaatctgtctagtgtttctttgcatatatcaaggaatacctgtttttggcctaaaaattttatgccaatctttatacccaaacgccaatggttaattcatcctttaaaaaataatacaagataactttgataaaacacctagaaagttcttatgtttgtctcttttcccttgaacagggagaagaactctattacaagtattatcttaaatatactctgaattagtggttctaaaatttgaatatgcatcagaattgcttggagggcttgttaaaacacagattactgggccttatgcccagaatttctgttttagtaagtctgaggtgaagtccatgaatttgcatttctaacaagttccgttttaatgctgaccctgccaatctggggaccacactttaagaattactgctctaaataaaagtgaataaagagaggattttaggttatggcagagtgaggagattggtaaatcctctctccaaaaaaagcagctataaggctggacacaaaatctccaacaaaataaaatcataaccattttagtactcttaacatctaaatagaatataacaatttgagaaggatttacgcttcaaaaactgctgaacttcatagttggaatctatggcaaccttgctcccaccctctccatttggttgtgtggaaaatctgcaagggttgggagtgttggggggtgggcaggttgtgcctctgtagtcaaacaagactcatagactttgagtggtgagtgattaatacgccctgaagagttgtcagtgaaagtgatgatcttggccagatgagggccaaaagcctgaagttatggttgtggttgggaccaatatatttctggctaccactgagcacatgcacagtggagaccaaagagaccctaagctttttatgtactcttgtccaaacctgaggctgtacacatttgcataggagccacaaaaggccaagaagaatataaaagccagagaagacttgtaaatggccttaaccgtggaatgcacttccctacccatataaagatctgtgaacagagaatggaagtctatctggctctagatatttgtgcaaaaggactatccagtcattggctgaaaacttacaatgaatcaggagtaacccttgggaagccagaattaaaaataaaaagcaagaataaaaaaaaatccaggcaaagatgtcagagactgctgatcatgaaggagacgtattttacagatttaagcctgggtaagttaccaaacaactccaaaaccttccagcaccgataactttcagataaaaaataatcatgttctggccaggcctggtgggtcacgcctgtaatcccagcattttgggaggctgaggtggacagacaacgaggtcaggaaagcaaaactgttttggctaacacagtgaaaccctgcctccactaaaaaatacaaaaaattagccggacgtggtggcacgtgcctgcagtcccagctactcgtgaggctgaggcaggagaatcacttgaacccaggaggcggaggttgcagtgagctgagatcacgccacggcactccagcctgggtgacagagcgagactctgtctcaaaaaagaaattaataataataatcgtgttccagagttgcgatactatatcattcaaaacacttttaaaaaatgggacattcaaataaacaggaatctgtgactagtattcagagagaaaaaaacagtcaaaaagtagaatggtgattactgtagaccagtgggggtgaagaaggaatagggagttattatttaatgggtacagggtttcagtttgggaagatggaaaaagttctggagatgcagggtagtgatggttacagttgagttttggccattatttcttcaaatatttattctctttcctctctttctggggctcctgttacatatatgttgtaaaaaaatatgcaaataaacaggtacttgtgactaaaactcagaaagtaaaaacagctgaaaagtagaatggtgatcaccagagaccagtggggcgaagaaggaataaggagttattgtgtaacgaatacaaggtttctgtttgggaagaagaagaatttctggagatgcagaattgtgtgaatgtctttaatgttactgacctgtactattaaaaatggcccaaatggccaagttaatgttatttatatatatatacatatttaccacaataaaaaatgtagacaatagaaactatgactgagtgtctccagatgttggatttagcaaaaatttcagagaattatattatattgccattttaaatatagttaagaaactaaaggatacatatatttaaagaattaaaggaaagtgccacaacaatgaatcaatagattctccactccccactatgttgatggccataaggatggtggcccatgtccgtgatacagtttgctgatgctgcagggaacaacatggaccttgtttttctatgattgagtgcgctggcctgtttgttgtctccctgagaaatcagctcaggggcttgcctttgttttacttaactcagaaatttctgagggctggagtggcctcctgaaagtatttaaaggcaaatatactagctacagcctcctgagataagggatgtgaaatcatgcaaacattagacatacagaaaagcctgggaaagaagaggcatggagggagagaagtgatttgaaaggctttcacatgtgccaggaaatctacaaagccacagataagcccagggctggattcatcttcagaaaagactcaagaaacaagagtttcacctctggttcaccgttaggatcagtgaaaacaggaagtgaaggctaaggaagagttataaatagcctgaataagtattgaagaaatgcctcaacatacagtcagtctgcaaagatgggagattttcttttctctttttttctcttttcctcttctcttctcttctcttttcctttctgctccttttcttttctttcggctctaggcatttaaggaaatacctgtcaaattgttatttgaccactaagctaacagagcagagacctcagtgaccacacttaacaaagaacacagtcttcatgcaaacggtttagaaaaatcactgaacaatcaaaacccatgacagcggccaacaataaacccaagggagggagagagagcagaatctgattttcagagatttgacattagaatattaaaagttcacttttcatcagaaaattacaaggcaagcacctccatgttccaggcaccgttctaggtagtagcaatatacctatgaacaacgtggacaaaaatccttgctcttgtgaagttggcattttattaaataaatatatttattcactaaggccttaatttttcagcatcttattatggtaattttcaaacacatagaaaattaaaacaattacacagtgaattgttcatatgtttaccacccagattctacctttgacattttactatatttgtcctatcttgtatctatccatgtagccacctatttatccatctaccaatccatcctttttgcttatagcattatatttaagaccacacaatgaaaacaacctaaatgttcaatagtaggggatttgttaaataaatttatgtatttgcactcaatggaatcatatgcaaccattaaaacttataattttcagactgaggaaaatctgtatctagttttaggagaaagcaggatattaaactactgtgcatttttattttaacactatgtaacaaactatacaaatcaaaagaaccataagctattgtagaaaaaggaaggatactttatctgttaggctagagggttttttgtaaccatttttttctttccccttttttgattttcattaatgttgttactgcattatttattccatacatacatttacaattttttaattgggacagtaaaatcattaactgtaatgtgcatccaaactatttagcaggacatggagaaaattgtaatatatttgattaactaattgcatattggatattttctagtgcctagatatacaaagatgaataaaatgagctattccttgcccaatagaagttcacaatatgttagagactatatatttccataaaagaataagtatatgatgaacaataattgtgctgtgtatgttatgtagtgattaagagtggattttgaactgattctttagatttgcttccaagacccatttcataccagctgtttgatatttggcaagttatttaacctcactttgcctgagtttcttatctctaatgaagttaaaattacttcctactcctcacatttatgtgaggagtaaatgagttaatacaagttaaaagctcagaataatctctggcacattataaatagtaaacaaatgttagctatttagttattattttaaatattagcatattgttaagatttcatgttaatatattggtattaagattctataatacgttagatttttcttcagaacttctactgattatgtatttatacatattttagtgcatatatgctgatacagtgaagtaaaggtaacatatttatgtttggatgatcagatattaaagttgcaaattttacttcagcccaatatatttatattcccttttaaaagtctttattggcaaaacatagttaaaatattccaacccttagaaacataaggtggaactcatttctaacttaaaaattatttaagactattttagggtacagactgattctcttagaaagtgttctgctttctattatcttagcgttggtgtttaagttgtataaatttatggcagcgtttggaactagctcaaggtttacatttgatcaggatatgtggtcagattaaaagcagtttttccttagctctaagcctaatgtcaatagaaaactatattgaaaagaaaaatgtctcttgagttttcagaatatgttgtgtaattccatggtaaatacaaatataaatattgtgattaataaaatgagaaaaacatgagaatttagatgcttgcttcctaagttaccaaagtgaaaagaggacatttatttttgtttgtctttacctcactttcacaaggaatttcagatggaacagttgccagtttataattctcctcttgaatattttagtgtcattaaatgggaataatttggatcacatacaagattatgatggaaatgatagaatgatgtaatgactttggagcgagttttgtcttgtctcaggagaactcataattggattgtgtttatggaagaagatgaagaagaagagacccaaaaatggaataacccttttatcttcatctgactctctattcttgtcacagtttttatcttcaggagggcacaaatagcctctatctgatttccctatcccatgcatagggttttcttaaagttttttcacaaagaagaatttatttttaaaaattctgttctattcttcatgtgttatttttaaatgagtttcacagagatactctgaagctgaagaggttgtttttaataatctgatgttacatgataagtactggaaaaaggtggatgcagggagtgggtggtatgataaaatgctgtgggtgtaggtcctgaactgcaggttggtaaatgtttttttggtaagtcaggagataatttaagcttacttatgtgattgctctattccccataatcctttgcaatgcttggtgagacagaatgaaagaactccaggtcttagctgtttgttagtgaactgctttttcttagagctgatgcttttggttatcaaggaagtctggatagtgatgaagacaagtgttgacaggagggaggctgaagattagggttatttttttgagtaagaaaacatgtaacttaattgtacacttaaaaataactgaaagagtgtatttggatagtttgtaatgtaaaagggtaaatgcttgaggggatggacaccccattctccatgatgctgttatttcacattgcatgtctatatcaaaacatctcatgtaccccataaatatatacacctactaagtacccacaagcattaaacatttaaaaattaaaaaatatatatgtgcatactctttaggaaaaaagaccactcccagttcagctaatatctgtgatctttttggatattttactcctgaaaatggcttcgatggcttcattagaaacaacctaaaatatttcttttccatagtgaataaattctgaaagatatttctcctcataaaatttaactaattaacctaatgccatccttggaatatttaaacgctatgtctgttgtgtttggtttaggaaaagacaaccctagaacccaatttttttcagattttgcactataaatttattcatatatattaaacaaagttgctgacagaaaaaaaaaaagttgtatatcctattacatgtgtgatttagtaatatcctttaggacacaataacaattatgaggtacaataaaatttcattctgtgcagagcttttcatggaacctctaacctcaattcttccatagcactgtactacaccacgcagtaaagaaacattttttcaacttatttagtatttgaggtataaaatctggagggggaaaaatgaggatttcagttggatttgaaatgagatggagagttaatgaaacagagagatacaggcgggattccttgggctgtcaagagtagggaagattgaagaggcaaaaatgaattcaaagtgcataggcagatgcaaagatatccatgaaggtctatcatccatgatattaactagagcaaataggcaaattttcttttccaaaaggaagctatatttaaagaaaaattaaacataaggggaaacttgagagtgatttgtaggaattcacatcaagcgggtggtcctgtttcttagcccatgctgaagcattccccatctgtcatctgaagggaaagagcattgaattcgtagtatgggagtttcccctgtggaggaatgagaagatgcagtgtgcagctaacaaccaaggcttgggggtggaagatgggaagaatctgaagagcatggaggtattagggccatgttagactgaatgaatgaaataaatacgggttagagaaaagtggagggaggaaaaagtaaaatcagtcaagaattctaattgcttactcatttggaaatgaatggacacttatgaatgagacctcgctgcccagaagataggaagtagcttagaagttgtttcctgatggataaagcagtgtgcagattccagtcacttgggtctgttcttgcttctcatgagcacacacctcacacgtacttgacctgagaggagatgctcttgttggaaactaagatttttttgtcctctcgtgcctcacattatgcagtcgctggaggtgaaagatcaaagctggaaaagtcatctttgaaggggaaacacctttcctcactcatgtttacgatttttttctgtcttggtttcatagaaaaactatgcaggtagccagagccctaagttgttgtgccatctgtaaacctgacatcatgtgcaaataacaacagatgatggaatttcacctagggtctgatcgtgcccagggagacttcataggctccaaatgcctgcttttatcttatacatcgagaagccattcaaactttcagggctctgccaacttggcaagaagaagagttggcaagcttcccatgctagttttcttttagtttgaaagttttgaagtgggtctgaggttgtgataaatgcttgtgaggtctcttatttgttgactgtaagcttttcatcatttgacatgaatgagaaacatcattcctttgcaaggatattcccttttttctgtttctttaaagttatcttagagacttctcagttactgtatgaaaccataaattctctgagcaaatgcctgttttgacagagagctttaaagatacatggcaaaagtttaaacaggtcctaactgatgggatttaaatactgtatatagtaattaaatagttgtgctaataaaaccctaaagcactgcttgcatttttcttctttaatctctcaaatttttctccaagactcaaaattcatgaattaaatgagttagccaagggaaatataattgtgttaaatttcctaagtgctttacacactgatgaaaaaatttaaagtttataataaatctacaaattataggtgggggctcattttaccacatagcttctttaaaatgaaactcccaagcatggtaaagaaattgcatataaatacttgctgcagaagtaagaatacataaaaaaactcactatgtacttgagtctatttgatttgttatgtttagatggctcccatatgaataaaataacattacaacaaagcattttatgactttttcatatggattgattatatattgtgcatctcaaataatctctatctcctttaatattcctctataagtcaccattacatagttttagttcttacataatgggatgctattaaatttcttctcccccttttcttaaaaacaaaaacaaaaacagaaacaagaataaaaaaacactccccaaaatgctatgctatctttttaaattttacaacatttttagccatgggcttcatatctagctcaaggtttattgtctttctactttttctaaatgatttaaggcttctctttctcactggacttaccataaagtgacttcttgctcttctgtcactttctgaaccaaaatttctagcctcattacactgtgagagacttaggaccaggggcagaagagaagccttgactctctttgaggactagcataacatgatatgaacatagcaggccactgatatgtgagcatcccataaataaaagagaattatcgccaagaagcccttactcagccagactacatttccagtttctcttgcatctaagtggaggcttgcatctagttttcaccattggaatgtcagataaaatgatgtatgttctttctagcctgttaggaagcagatgtgacttctccatgctgcctttccctgtcagctgactggctatagaagactctctggacatcacaatgtcatcctagccacaagatcaaaaagagtagagtttctgtgtcaccatgtggagaaaagttatccaccaatctgaaacaattacgttagactactgcatgggcacaaaataaacctctgttctgttaaaccactgaattttttttatcgcaggtaatgttatcttcactaatacagggaagaagtcctgctgcttgtcagacttagtagggcccactaatcctgttgaacccagaagaacaggagcaaagctgctctagtgtgttgaatggcgccaataccttgtgaatgagagaagtctgcttgaccaaaagacctaggatacaatggatgccttctacaacttcctcttagtgactataaaacagagaaaagcctcttctaggacttccatggtagattttccactgcttaagcaatagcatctgcttagtgaatatgtctgctaaagaaaaatccagacaagttaatattcacattttatttaagaatattctagatgaggaagcaataattgaacaactagaagtgtaggctgtcattaaattagagctaatagaggaactggaagagaactttatcaaaaagagaagtgctctcaagaagactgaagaaaatcgtgaaaaaagagcattcaaaagtattctggaacttaaactgaaaattctacaaagctcaatagatgagctgaaaaagaaagtcactgtgttatttatcatgtaagattaatgttaggaataacacataaaagaaatatttcacaatacagtgcaaaaatcgaaaaaaatccacttaattgtaaaactagctctgaaaaactgtggggaatatatatggagagatccaatatttccacttcttgctctgtatacaaaggaattgaaattagtgtgccaaagagatatctgcactcccatgtttattgtaccattattcacatagccaagatatggaagcaacccagtatctatccgtagttgaatgaataaagaatatgtgagatacacacacacgcacacacacacacacacacacacacacacacacgatggaatattatacacccttaaaaaagaagaaaattctggcatttgtgacaacatggatggacctggaacattatgacattatgctaaatgaaataagccaggcacagaaagacaaatactgcatgatctcacttatatgtggcatctgtaaaagtcagtctcacagaaacagagagtgaaaaactggttagcagaggctggatggggatttggagagaagaggagctgttgattgaaggatactaaattccatttagactggaggaataagttttagtgatctatttcactgcatggcaaatgaattataaggtattatgtatttcaaaattgctaaaagaattgatttttaatgttcccatcacagaaaagaagttggtaaggtgatagatatgttaattagcttgatctttctacagtgtatacatagatcaaaacattacattgtacattatatattatataatatattttatataaaatataatttattttatatattatatactttatataaaatataatatactttatagtatctattttatatctataaaatcattatctctcaaataaataaataaataaataagaaagaaatttacctagagagcaaaatgccacatttataaacctttaaagcacttgggtatcatattttgcttaacaagtattgctcacctcagagtcttaaaatgttctatttaataatactattattttatctttcaacatttaatttttaaaaatgtaatttttcactctgatgataatttcttttgctgtgcagaagctctttagtttaattagatcccatttgtcaattttggcttttgttgccattgcttttggtgtttagtcatgaagtctttgcccatgcctgtgtcctgaatggtattgcctaggttttcttctagggtttttatggttttaggtcttacgtttaagtctttaatccatcttgagttaatttttgtataaggtgtaaggaagaggtccaatttcagttttctgcatatggctagccagttttcccagcacagtttattaaatagggaatcttttccccaattcttgtttttgtcaggtttgtcaaagatcagatggttgtagatgtgtggtgttatttctgagggctctgttctgttccattggtctatatatctgttttggtaccagtaccatgctgttttggttactgtggccttgtagtatagtttgaagtcagataacatgatggctccagctttgacaacctacagaatgggagaaaatttttgaaatctatccatctgacaaagggctaatatccagaatctacaaggaacttaaataaatttacaagaaaaaaagaaccccatcaaaaagtggacaaaagatatgaatggacacttctcaaaagaagacgtttatgcagccaacaaacatatgagaaaaagctcatcatcactggtcattagagaaatgcaaatcaaaatcacagtgggataccatctcatgccagttagaatggtgatcattaaaaagtcaggaaagaacagatgctggagaggatgtggagaaataggaaggcttttacactgttagtgggagtgtaaattatttcaaccattgtagaagacagtatggcaatcccttaaggatctagaaccagaaataccatttgacccagcaatcccattactgggtatatacccaaaggattataaatcattctgctataaagacacatgcacacgtatgtttattgcagcactattcccaataacaaagacttggaaccaacccaaatgcccatcaatgatagactggataaagaaaatgtggcacatatacaccatggaatactgtgcagccataaaaaggatgagttcatgtcctttgcaggtacatggatgaagctggaaaccatcattctcagcaaagtaacacaggaacagaaaaccaaacaccatgtgttttcactcataagtgggagttgagcaatgagaacacgtggacacaaggaggggaacatcacacaccggggcctgtcagtgggtgggggactaggggagggatagcattaggagaaatacctaatgtagatgatggattgatgggtgcagcaaaccaccatggcatgtgtatacctgtgtaacaaacctgcatgttctgcacatgtatcccagaacttaaagtatagcagaaaagtttaatttgatgtattgtatataggatgaggtagaagttcatttttttccacatgtatgccatttatcagtgccatatactaaaaaaagtatccttttcccgttgattttaaatgcagctttcatgatgtattctatccttttctggtatatattttctgggctctttttttttaaccaatattttgtctattccagtagccatatcatgctatttggttatgatgtcttcgagactgttataatgtttggtgaaaaaagtactgtcagtactgttttcttttttgtaaacatttttgactttctattcattaattgaattttaaaatcatttgtcagtttacaatggttactggaaaacattgacgttgtaattctatttttcattgcttactttacatattttatatgatttaacacttttaaaaataaagatattatacctccattatgaaattaatttttacatgttttataatttatattgcttttgtaagtaggactttttaaaatatccactattatttgattattattgctattattgaaatgctgctgacttttttatatgtatatttgaatccagctactgtatttaattatctaactaactcaacttctttcttaaattggaaacaaagactgtcttttcttcacaatatttttacaaattatgtcatttttagagtcatttcattagatagaacttcaaaggcaatattgaaataagtatgataaagcagccttctttatttttttctttatgtgaatggaaatcatttcagtgttgtcctgtatttggtgtttgctgttggactttcataaatagtctttaagatgaatcttcctatccatatgttaagtagagttttattacagatggctactgaatattactaaatgccttttaggtgtttattaatacaattacatcatttttctcttcttatttgttagagaaggttatggtatcctagaatcagagagagaaaaagtcaagaaggaaagagtggcacctttatataaaaatataaagcctggcttatgccctggtgaaacattcagcaagggagataagactaaagtgtttatatcagcactcataggatataattcacatgaaattatgcagttaagagaggaagcacagatatgagtgaggtctggatttcacaggaaaggctttttgaaaaatcacaatccttaaagctggaacaagataggacaagcttattcatgacattatgaaagcagagaaaagattaaagaactgaaaattgcatatatgtggtggcgaaaaagttattcagcccctagaaatgaaaatactggtgactttaaatatatgaaaacaatacaaaagataatttgttcttcttcactagagatagacaagagaatgactaaagtactaagttaaacaaagaaaattatagcaatgtgaagtgttagtcactggaatcttttacctcccaacacagttttctgcaattttaaaaactttctcttctgcttgaaagcagggacaaggagacctttcttagaatcaagattcattgattttatgaagtatattcagaaaaaccagttctgctgcttagtgatctgtttactcctgaaatcctgaagtgtcccaaactgtagggaataagatcagaatgtgtagggtttttagaacctagaacaccatgaaattgcacaaactagggggaaaaggactgaacaggcacttttcaaagaagacatacatgcagccaaaaagcatatgaaaaaatgttcaacatcactaattattagagaaatgcaaatgaaagccacaatgagataccatctcacaagtcagaatggctattgttaaaaagacaaaaaataacaggtgctggtgaggttgctgagaaaagaggatacttacatactgcttgtgtttttgtaaattagttcagccactgtggaaagcagtttggcgattcctcaaagagctaaaaacagaattaccattcaacccagcaaccccattattgggtatatacccaaaggaatataaattgtcctaacataaagacacatgcatatgtatgttaatcgcagcactattcataatagcaaagacatagaatcagcctaaatgtccattaatgatagactggataaagaaaacatggtacatatacaccatggcatactatgcagccataaaaggaacgagatcgtatcctttgcagaaatacggatggagttggaggccattatctgttcctgcatttgcaggaacagaaaaccgaataccacatgttttcacctataagtgggagctaaacaatgagaaaacatggacacaaagaggcaaacaacagacacgggggccttctggaaagtggagggagggagaaggagtgaatcagaaaaaatatctgtcaggtactatgcttggtacctgggtggctaaataacctgtacagcaaaccctgtgacatgagtttacatgtatagcaaacctgcacgtgtacccctacacctaaagtaaaagttttttttaagtgcacaaactagaggcttcttttaaaagatggtggagtgtaaagccaatttatttgcactagcttcttttgaaacccaacaaaaacaacaaaaaagaaagaaaactcaagaaaaccatcagtttatttaccatgattcattatgcctgaattctttactctgatttatttctttgatgcttatccttgagtaggtttgtttgcttgttggtttgaaagacaagctcaagatatttcactgtttgaggttttttttgttattattttttttttttctgtttctacagcttcttttctggcctagttgaactacttttattgatcagaattggcatgttacaatctacatactaatccacatataatctttcgctccttgctcctagtttttcatcttccctggtgaactaccgattctttataattcagctcaaatattaataccacctactttgtgtaaactttcctgacttccccaggtagagctgactcttccctcttttgctacctttgtacctttaccatttctttatcttccacctgtaatgataggcttttactttgtttttttcttgtttgttatagaccaagttgggatcagtccctgctctacttacctcctccctgagaagcttctttcttcaatcaggggcaatcttaaacaggacattagcactagatacacacagacacagatacacacacagacatgcacgcgtgcgtgcgcgcacacacacacacacacgcacacacacaccccccaaataggttttcttgaagttttacagaaaattcctggggagacatggaagaggattaacatgatgcactccaaagcacagacttaataaaagtgcattggctacctctatttttccccaagcaaaatacctcatgtttttctttctcataatgtcatctcttccatatgctttctaaaatgtgcccttcctcattctaagcaggttagttgtcaccctcagcttgcataagccacccagcagagcaaaagcctctgttgtttctaaaacctgccctcttgggggcctcttccttccccttaggttgcttatcacagtctccagtatttgaaaattcatctctcttcttttggggagccagtaaatagcaacaggagattaagctgctaataataactaacatttatagttagcttattgtatgccaggcagcatactaagtactttctatattacattaaataagattatctttatatccctctacctgcaggtttgtctcctacggaagactgtaagcatttgcacagtgatgactatattatttttttctgtattcttaatacttagcaacatgcctggcacatagtaagcacttcataaatgcttgttggatgaatagtgtgtatgcattgatgtgatgtaattggtggtgagaagaatcagcctgttcacagtaactttagtcatagttctttttatatttgttttttgttttcacttcaccatggttgtcttccactattcatcatgtagtcagtacaagccctggttgtcactctgttagccatggatattttcagctcttatattctgacaactaattattccatgggaagtcttttaatcaggattctctttgtttatattgaaatgactaatatctttctcacacatctcatttcagcaatatgagttgatgctgtattttggatcatgtattttagaccaggtggccaggcagcagcactccccaccaatgcagacaggttaggttttcagtctgtgcttggtgcatctctagggggttaatgaagccttcccgtcgaagccgctgtgatgagaggacaggcaggactcctgctccctccccacctgctctgagttctaatccgagcagctcttcttctgtctggtttacatattcatcttttgggtgaaatggtgttaaatataatatatttgaaaacgattgggttaaaaaagctattctatttaaaatatcaagatggccatacataacacagatagataggtcctcaacattagcaggttgggtagtgtagtcaactgctgaaaataaatacagcacaacccaacaaaacacctttcccctcaaacactaacaaagtaaaataaaataaaagcaaaaccctgaaacccaagcagaaatgtaaagctgaagagacattttctagattggtcagtcacagcagtgtattcagaaggcagttcttcctccgggtttgagaggcctgtagccatgtatacagaaactatcttgggtaaggtgcctctactctgtcgggcttactatttaagatccttagtgggtgtcagaggcctttggcctgtactgcacaggtcttttcttgtttgtggaacgtcaaattcattttctctccaacaggccttttggtttcttaaaactctccggttcttgtccctgcacgtttttccctctcaatggcatttgactcaggttgccagtcattaatttccttgtatggaattaaggagatcttctggtccattctgtggctagaggcaataagagaacccatcctcatagatctagtctcaacatgaagcattagaatgtaaactcccaactctagaatataaataaggtcactgaggacagggatttctaactgttttattcatagatgtttccctacctcctagagcagtgtttagtaatctgtaggcactcagtaaatattgtttaaatgaatgaaggaaggaaataccggtctcacagtcacgccttttatacttttgagaatgaatttctcaactgtcttatccctcgatctgttattaactatgctaaaaatatttcctggctttgagtagcattgtagaaggtcctcttccattttccgattttcatagatgatcttccattaaaaaaagacgctggcatgtttctgctgtagaaaaaaggaagcaaagggatagttacaactccttctactcttctcccccagaaaaacctttcgaggcctcaccaatagatggcttgctttctcctccaatcaccagcagacagaggggccctggtgtactgctgtgttctccacaccaagggggaaatgaataatgtgtgagattcctctctggaatgttgagtgtctcaaccttccttctacaattatattttctgcttcacggtgatgacagcatcacctgtgggttcagaatcagagacctccagcttctgtccccattttggggtaatgtatgtgccacctttcttggattttatttaatcagtgagtctcctccccaggagattggggactcaactatctctaaacattttctcatcttttcttcacctagggttcctgggctcctgttgggcctcactggaagctcctagggttaaaccaaccttgggcattaatttcagtgtctgttctccacagtcacaaaaatatggacctctagttacacttcataaaatagcagagatcctacctagtccactgacagatgtcagcatagcatcctcttctagaaatttactagcttatgttttctgggtacccccaaattctatagcaagatctaattctcagtgcagatcttaacaccgtatctgagtattttgtgtctatatgagtttgcctattcataagagtccagcgaatggtattaaacatccccttttgtctcctgcaattgcccttagatccttcctgaggatatgccagtctagttatgagaggtgatccggacgttgttcatctagagttaatctggacattgttctagataaaacacacataaaaccatgaactctaaaatgtcctcagtcctttaaggatgatagaatgtgcttataggttatagctaggttgattatataatttattatttaaaacatgacaccttgaaagcaaaagggaacggtatttataattacattgcctcagaagtcataaaccaggacctgtagtcactctggttatggcagaaatcttgcattggaaaatctttccttcaacttatttcaccctacatggtgaaaattttttaaaactcttctttaaagtagtctttcaccttaaggattcactttttccgaaccaccaatgtcctttccgatataattatgtggtctaattcacccattccttcacattgttcatgttcttaaccactttctctatctttactagagttggctagggctctagagatgtcctaagctttttcttgaatagcagctgactggacaagtgaagactttcttttctaacttatcctaataaattggaatctcacttttgttttgtttcaacgccaaatgaggactagcagtggcaagataagggtggaacagaggaggaaaaggaaggacaggataaaggaaggaagcctaccacttacgtatacatcacacctgggatgctcatgctcttgtcccctgcctgcgttagccttggactcactgctcccttgagatgccactaagagggaaagggagagcatatttagaacactcaccccaccccaactttaccaccttcactgatgctcctcaagtccttaaccttctcgctagcttccccagcctccttcctggtcttgagcagcattcatgcggagtctcaaatcagagccccttgccctgcttcctcacttgcctcatactgtctctgtattgctttcctcttgcaagaactcgttcaccacactaggagaaaagcctagaagaaccctattcttattgctttatggatgagaatgtaaggggttaggaagagcccccattttcttatctttatgttgaaaacgcagggtgatatgtggtcttgacacatcaatttagaattccgaatttattttctcatcaaaacccctttataactggccatttggtttcaaaatactacaagtagtacccactggatatattagctatattggtgtttaaatagatgtttatattcttatctatcagtctaattaccatgtataatagtatttccatacaaaaatctgagcttagttcctcaagattgctcagataaaatttggggagattgtctatttataattaggtctatctcccttttttgctagttctcatttgaatacattcaattccaagctgttaaaagttagcaatgctaatgatagtgatgatcactaatgtttattaagcagccttcatgtagcaggtgctgcgttagttactatattgtcattataattcatatctcactgtgatgaaagtattatttccatattacagatgaggaaagtgaggcacagtgaagaagagtgaggggcttaagcttatgtaatgaataaatgataaagctaagattcatgcccaggcttgtcagactctgaaattggcatatttttacaatgccatgtggccacctgtgcctggccatattttaccatgtgttaccacgctggtgtgtctattttaggttaggagcaattttagagagaagcagtgccctaatctgcatcttcaatgccatttaggtatgttagttaggacagttggatgctaaagcacttaaagtaacttttaggtcatttgcattttccaacagtggtaaatgaagatatcaaataaatcatatattccctttgatttggagttgcttgctatgttctctcccttctgctggtttttcattcattgcagccaatagctattggattcatgttgttggctaaatctaccctttttctaatcatgcttcctgaaggttggagggggaaatatttgccataaaattgatttctaagggcagggcaatgagtaaggccgatatcggaatgttgatagaaaaaagcccttcttttgtcttgttggctgtaaaatatcttgcatggcccagagtacaatgaacttaaaatacaaggagagcgcagtgcaagtcaccatgatgactctgacatcagtattttccatatctcttttaacccaattgtgactttgtagaatgtaaattgcatagaaaatatattttttcatactgtctctaaatcctagtttcctttcttgtcatattcttttttttatttttcaattaaaataggatcctgttttcctttcttttcatagtctttttttatttctcaattaaaacaggatgggtaaaaaggacacaaattctgccattgcaaatgatctatcagttttgggggacatactgactcaatgaagatccagtgttgtctttcaaaatttcatttacattccgctcattcacacttttaattgttattcccttaaaaattaataaataaaaggagccatcttgtttacatatttctgcactttttttcttcatagacagaagtctttcaaatctgattcatatttcttttcagattgcactcttaagttcaactcttcacggacgtctataatattccttatctcagctagttctccagaatatgcttatgaaacagaaaaggttcccttgtccccctcacagggcatgtggtgggggtgtggctcacttcttcagtgtcctgctgctgaaacctctaggggagcatacaaactgacaggctgtggggctccaaacccacgacagtgtctaggggtgaacgctgagggccccagtgggctgaagccccagtgggcgtgtgttacagggtgcttttttagtttagccatttgtaggtggcttgtattagctcagttagactgtggtcttaattgcagagacaaagggctttctgtatcctgggactcttgccttggtgttgtacggatcatatgtggacttggagaatgagtgcaaggttttattgagtggaagtagctttcagcagatgggggagccagaagggagatggttttcccctagagttgggcctccgcttggcggactgggctctcctccaactgccccagccaaactccatgtcgttctgctggttggtggcctgctggcctgccgacgtctgtcagtttgttcttctcgacgtccagccacctgtgtgttctccgctgatgtgctcctctccatatccagttgcttctgtgtttgcctgctagggtctcgcaggttttcgtaggcacacgatgggggtgtggcagaccagggtggtcttgggaaatgcaacatttgggcagaaaatgcctgtcttcacctaggtccatacgggtggaaccctagccagggaccatgctctcctcctagcacttcccttcctgccttctgtatcatttaaagggaccactctcttcccttcccagcactcccatatcacttacaaccaacctctgattatataggcaaaaaaaaccatggttctagtgaacaacctgaaaaccacaaataaaagatgcatcaacgaattatactgacattataggaagatatgcaaatgtactatttctatggaatgaatactctggggacaatgtctcacgctgtgcattatggaatcatgaatttcagcagtttcatttttctgtgttttacattaaaatagcaaagaaagagtacatgtctagaaaactatttcttagtgacctgttagacacatgccagaatgtctaatgtttttcacatgtggttcacctgagcctgtaagatttgataatgcaccattctgaaataaatgagtgcctctaaatgtagtaacacttctcatgtccacttaaaggtcaattatttcaaccattatggtttaggaaaatgggctggttaaataagctgagtaaaataagcagcccagctcaccaagaaaggacctgatttgagagaaatgggactaggcttgcttttctcaagtccatcctcaatagccatcagtatcatataaactaaaatcttatataatcttattttaatctcaatataagataaaatctgacctttaataagccccactgtctacactttttttttttttttgagatggagtttcaccctcattgcccaggctggagagcaatggcatgatcttggctcactgcaacctctgcctcctgggttcaagtgattctcctgcctcagcctcccaagtagctgggattacaggcatgcgccaccacacctggctgattttgtgttgttgcttttttttttttagtagagacagggtttctgtttttttttttttcagtagagatggtttctccatgttggtcaggctggtctccaactccagacctctggtgatccacccgcctcggcctcccaaagtgctgggattacaggtgtgagccaccgtgcctggactgaagtctacactccttaacatggtgtacaaagttcctgatctcgccactgccagcttttatagcttttttgcttatcctctctgtctactacttttagccacctgaactgctaatatttccttccaatgtcctttgctttcttagccctatgtctttgttaggctgacttttctttttctccttgagatgtctttttttctttttgcgggggttgggggggcccaacatttctcgatctcatttgtggattattttcaggatcactgtgttgtccagaaaacggacatggaccattgattaggttgggttgggctgtcttctctaatccaacagtaatagaataaccaacacttacagagtaatgtgagaggctcttggtacatcctgtaggtgcaagttatctaatttgacccctctacccaccctatggaggaaggtatatgaggctgggtcttatgtaataataactagagcacggattaggtactggcttttcagtatcttttcctcccatgcctttatccctatatctgcatgtataactaggtccagaggtgggtaaaccttgatgagttcattcacttctcatattcagtgattgctcaggaaagggcacgagattgggttgtgatctagagggcactaggggagctattaggtaggttgcctttacctagaaagatgagatcgtctgtatgagagcattttgcacactgaaaaagccatcatgctagttttaggcttcaagtaacaagaaacccaaaagattaaacaacaagatttattatctcacatcacaagaagttcagagataaggcagttccaggattagttaattcattagttaataacaataaatatataattaagaacccaggtctcttttcatctttctgccctgccacacttagtgtattggcttttgtcttcagggttttcacctcgtgtttttgatatggctaccacgactcctagactacctcattacacagcatttacaggccaggataggctcctcttcatgtcattatatgacaataattttcatgtcctttttaaagcataaaataaaaattcccacacacctccaataaaactttctgttctgtcccataagctagaactgcatctcttgcccattcctgagcagtcagtgaaaatggaagtgaaatgacatgattgccaagactgatcaaggtttattccctagaaggattgagtttcccagaggcacatagtcattcaatgtttgaatgaaattgggattttggtaaaagaagaaggggctaggtcatgtctttttattaactagtggtacctgccacagcactatacaaatatgagctctcatttttaatattagtatatcaatgtttaatatatggcagtggtttcagaaagattcatttttgagataatttttaagcaaagagggtaatagtgttttctttcccatgttttaggttgggttgcctcagaagcagaacctaaaacaatgatttgagtgcgactagtttatttggaaggtagaggcggaggggaagtgatacaaggatatagggaagagaatggattatcactgggtgaccgaagctcattgccataggggcactctgagaaatggtacagaattacatgcagagttatccctcagaaggaggaagggagctggggtaattgtaccccagcttttgccagttatctgttgagaaactcagggaagtgtgttaatgtccccagggcccttgtgatatggtgttttgcagcttgtggggaagctttcaggcaaagacatacagatattggaagctaaaagtcccagggaactgataaggctcaggggatgtgagaccaacaacaactgccacattcctttatgtccataacacaaaataaagagcagaaatgtcacagagcctgcaaagggatggagatttgtttcgtcaagaagggaaagaagcactttcatattttttatttagctctcaaatggggtactttctaaagctgtgtgatttatgtatgtattatagccagttgtttccctgcacactgcttacattcatgttatattctggcagaaaaaatctgattttaattgctctaaaaatacatgttcttatctgcaggatttgtattgaggcttactgagagcagcttaaaggtcaaaaccttatatttaaactattagctctaattgttagcggagtacattttaatgttacagagttggttaaactgctggtatccttccaccttccaagatgattaagagcgcggaaaaataatttatcttaaatttttaagtgtgtgtttaattttctcatttatggcatacgtaacagaatggcaattaattattaagtctaaagaaagagaatcattgttcaaaatcagtacactatgcttcatttaactcctataaatatcacattctagagacataaacttgcgcagtcagtagcaaaaggtggttgttaataatctgttagtcactgtgtacactcaattggccaagcattttctccacttattcttttgttattttctcttttattgtcccaagaatacaaagcaattagccaaaattatatgacaatctctggaaattattttattttccatttgtggtttggggacagggaaggtaggaggaggagggatggaaagaacttgtcaaaaattgaggcaggtgtagtagattgaaatagtaggatctcaaaacatgtccatatcctaacctctggaacctgtgaatgtgaccttatttggagaaatggtctctgcggatacaattaaggatctcaagaggaaataatcctggattcagggtgggcttaaagtcagatgtacatttgaaacacagggatacacagggaaggtcagagggatactggagacacagtatcccagaggacaagagcttgtgaagatggtcacagagattggagtcatgtggtcccaagcaaagggatgcctggagtgaccagaagctggaattagcaaggaagattcttccctgtaccttctgaggtagtacagccctactgacacattgattttggacctctggcctccagagatgtgacagaataaatttatgttgtttcaagtcaccagttgtgtggtaatttgttacagaaacccaagaaaacttatatagcaggtattttattagtggtagtaatgataatggaggtaacgttttgcctataattttatagtttaccagatgttctcatctatgattatcagagtcaaatggtaagctgaatgatacatagaaattaaatgtcctgccccagctatagccataagcagtccagtatctcagacacagagccactagcccacaagaagctacctccgggaagggaaggttgaggagcttcctcaagcctctaaggagtaacaaatcctggtggaaagttttttctccccaccccatattttctaaagccagccttataaaagctgtgcttccattttctcattaaacgttcctctcagccagcactcgacgttcactgtgtggacacattccaatgagttttgtttttttctttaccatatggtgatttcaatttgtactcactgtagattcattcatttctttattaaatgcacatttacttcatacttcccaaaggcctaacctgtgcttatgctgaaggacaatagcagtataatgattttagtacccatgtttcttagaaacgtagccttcacattttgtgcacaaaacaatcctgtataactaatcttttttttttttttttttgagatggagtcttgctctgtcacccaggctggagtgcaatggcgcaatctcggctcactgcaacctccgcctcccgggttcagccattctcctgcctcagcctcccaagtagctgggactacaggcgcccgccaccatgcccggctaattttttttttttttttatttagtagagacggggtttcaccgtgttagccaggatggtctcgaactcctgacctcgtgatccgcacgtctcagcctcccaaagtgctgggattacaggcttgagccacaactaatcatttttaacaaaaaaatttaaggacaagatttgtgcagtattaagagccattacttattactgtgtgactgagatcatttatagtcattcaatgtttgagcaggttagttttcattagcagtttctcccccctcttggttaagagagtgaatgtttcagatgtggtgacttggttgcctgttgttcaaatatacgctactggcagtttctcaaaatgtcaatcacttcatctctgctttaatttactacatatattgctcagagtgctgaattaatgatgtgaacttgaagtttcaggtcttcaagtaatccctgggtgatgcatcgggattaggcctttgtagtagaaattatggacatgcgtgctgagctttttgtgtcttgctattttttcagccttgtatgaagggccaaaagatgtgaagccttattaaacccagtttatgggaatctgttgttttggactgagctcctgcaactaggcccataccagaccaaaccagaatggagtcactcttgctgggtgccatgtaataaccaaactgaatgaccagttttccaaaaaacaggagatttcacagcaaccaatcagaaagggctcagtctacctaaagcctggaggataaggaaattctgtctactttaaccttataaggaaagtaactttgaaatgaccaatctgcttttcgttctttatttcttgatccttatttctgctttctttagcaatttctgtctataaagtcaacacctgctgctcggctcatgggagtttctcctgttttgtagacaggatgctgctcaattctgaatcgctaacaaaagccagttctatctttaaacctcagttagtgaaaattttgttttttgacaagctataagaagcacatagccacatgacttatgattatacatttttagattatttcttaactattaagattctcaaaaatgtttaggaaaataaatgacctctaggtttaggtttatggtggactaagtggtgaaccatttgatcttgaaaaaagaaaaagaggatgaaaagtaacaaagttgcactcatccctgatttctaaacatctggtcatattaaaagattctcatgtattccagaacttaaagtataattaaaaaacaagtttctcttttttaacttttaatcctaaatagtatgtagttttaaattctcatatactattgtatacctcttttactacaatcatcactttctttgcaaatattttcattggaatcactagtaaagccatatattgccttattcacagtccaggtaaagaatttgagagccttcttacctgtgtttggacattcattttttggatatactttaatgtgtccacatggatatacttttggatacgctttaatgtgtccacatggtaacttgaagcaatagcaactatgtttaacttatcaaattttccataaaccaatttgatggtcaatccctgtaatatttagttcttcttctgcacaagatatgttcttgttacaagtctttctacttattaaaaaaaataccagttaaaagagaaggacatttaggctctatcttttaaaacctaaattattaattacacgtatgtttcttgaggatggtgtggagatccagctgtgaaagcctaaaacacaggaagggccacaccgtcagattcgagcgttgctttatctggaagggtaatttcattttcctcagtgtgagtggtgaacaaagaggaactaaaggtagagaccagatggagaactgggtcacttttctgggtcttgttgtatttggatttttattctttgactcaagttttgtttcagatgtggtgaactttaagaaaggaggatatgctgacgttcaaatataaatatgtattatgttcttacttttatccatgcttctgttttcctccactggtataaaaattgccttaaatatagaaaagaaatttttttctacttaataatgtatgttatgtataattgggatcaatgaataatctcgttgatcaagagtgtcttcaaatacagatgtattttagaagggaatggagattgctttatgtttagcatttcaatgtgtagcatttcaattgagcatctactttggatcagatcctcagagtctaaaaatagttttaaaataatttcttcattttcaaggggcttaacattaattgatggggagtaggggaaggatagtttttgaacagaaaaataaaagacagttactaaagagaactatgaaatatattgttgtccttggagacagagtctaaaaatagttttaaaataatttcttcattttcaaggggcttaacattaattgatggggagtaggggaaggatagtttttgaacagaaaaataaaagacagttactaaagagaactatgaaatatattgttgtccttggagacagaattagggacaatagatgaaagaggcaaggagagaggttctgacttattaccagaataagcttgataatgatccaagcataaaaaacgatagaatgactctgtctattgggagctgatgagtactttctagttagaaatatttatgcagaaaatgaatgattttatctgagtactactacttggtttagaggattgaaggaactgccaagattcctttagaatttgagattgtatttttgaattagttaggcatctttataggagttatcttggctgggcgcagtggctcacgcctgtaatcccagcactttgggaggctgaggcgggcggatcacctgagatcaggagttcaagaccagcctggccaacatggtgaaaccccatctctactaaaaatacaaaaaattagctgggcgtagtggcgggcacttgtaatcccagctactccgaaggctgaggcaggagaactgcttgaatccaggaggcagaggttgcagtgagccgagatggcgccattgtactccagcctgtgcaacaagagtgaaactccgtctcaaaaaaaaaaaaaaaaaaaaaaaagagttatccttttctccttgaagtcttgccaaggacttgggtgggcactgtgttggttaggtagctaggaagctgtggttgattaactgttaaagtcttgagtatatagtgaagaagaagaaacagggcagaattaattatgcattaaggcctcccagtatcttccgttagctgctgtgattttaccaggaccctcactttccttcactttccttggattagatggtcaggtggcactgaagtgacttgtaccaacaggcttaagcatgagaactaacctgatcatattatatcctaagaaggtattctagaattgaatttgtagaagatttcactagttcttcaagtatatatttttagattcaagtattaaagttagcactaatgtaattcactttgtttatggagaattgtttacttattagaatctataaaatagttttgatctaatggaaacaggcctgttggttataggagggaaatgtatcatggtttgacaaaaaaataaaaaataaaggagctggggcatgacagctcttagaagtaaaatcatttgaactatttgtcattgggagaaattacctacagtatcaaagagttgtcacaaagaactttcccctgatacccaacaacatatatgtgtatatatatatgcacaacgttgacttccagtgatctccatttaatataaaataattatctgtgacaattattctttaaaaatgcattctccattaacataagtggaatttcgactagccaacactttgaacttttatgtctcaagtggaggagtttactgggtacagaaaaatgaaggaaaatccatagcctgaatagaagagaaatgagcttagttttatattatactttaggaagaataaagaataatatatgagagttggaggtgtagagaacatatgtgaaatagttggcaattatttattttattccctttgaggacagttcatctttatacataagtattaacatggttaaatgcaaggaatctttaggagcaaaatgataataagaggttatttttatctttgaacaaaatctaacctaactgggctgaaacccaataggtaacattggtgtgtgtgtgtgtgtgtgtgtgtgtgtgtgtgtgtgcatgcatgtgtgcctgcatttatgtgtgcatgtatacattaagtcacattttttatatttgtttcacttttgattgaaggcagatattgttggagaacagatctatttgtgaaaccttattgggaacatccaaattggcaaaatgacttggtgcccatctgcagtaaattaagatgtacatctgactaggttggggcttcatgccagtgcctgtctcaacatgttcagtttttaactgaattctgtcaaaattccgagtcagataataattaatgccacagacatttaatgcatctttattatgcaagtgcctgtctttgtgactgtagatttagtcagaaagggtcagggtggcttcctggccatgatattagcctagagctctccctactccctccaacccccttccttctgttttctgttcactctcattctaccctgggattgatcactgggatagtggttggaaaatgttacttcattggtgaagaaagctcatatgagatctatgttgtttgaaagcattatatggtgtcctagttaggattcttccaaaagcaaaacctgacacagtgactcagatatgatagtttatttgataggtagttccaggaaacaagaatgagggagagtgaggcagctttaaaaaaaggattttaatgagcagattaaggataagggtaactaggactaagtcctgctatagatcttgtataaaatagcctcagaattgtctacacctagggacagggaagttgagtatttgttcacttaccccattcttcattgttggtgttttctcttgggggtgtttaatctctggcactttcagcctgccctaaacatggactgagcaggtggagaggcagaaagacacaagtgctttaagttggggagctgttggtgtgtataggaaccagatagcttcaggtgaactcagaggtgggctaagaggacgtgaagcagggcatcaccaatgtaagttccatgcggtttctattgaaaaggagcttcagggctctattaatgtatagaatgtctacttctgttttctccagctcatctacttgtctcaaaccaactaaatgaccaaaaggaaaagttggaaatggcaccagtggttcatcctgctcattttccagcatagtccgaaggtagacaattctcatactttgcccattttagacagtcttcctcaggatacagatggcaggaaggaaacaggaacctctcagaaatccgatgcagctccttactagatctctattttcaccttctttgcctcttctcaaatgtggatctcaaaataccatctgcttaattgacctaatagcaattgtagtggtagtgctatttgctatcttttctcgagtgcttaccatgttcccaccattattttagcactgttctgtataaataatcagaacaatcccatgaaggggatactataatataatgatcccattttaaaacatgaaaagaaactgaggtagagaacgattacctgtccaaggtctcaaccgtgggagggggtggagcatatgacctgagtaagctgtctagagtctctcgtacactgaaaccaatgcacccttttctcagggctaaacccagctcttggccccagggcaggactagaatatccctggtcctcatgccagaaggcttgtgaatcaaaggctggagcaatggaggagagatggcaacttattgtcacaagccttccctctgttacacttcctctcttcagtccattctccatgcatcatctgaaatgatatttaaaatgcagaaatcagatcacaatacacccctgcctaacactctctaatgagtcctactgcacttagagcaaaatccacaatttgctcagctactatgagcctgctcttgcctgtcttctagtcttcacctcccacctctctacgcatgactctctcagctctaaccacaccggccttctttctattccaggcgcataaggaactgatacccacctcaggacatgactatgtcccactcactccttcgtacattgtcatctcactgtcctcttgttatccttcagatgtcagctcagatgctgcctcctcagacaggcttctgctgaccgcccccctctcttactctaggcatcttattaccctcttctgttttctgtatagcatgtatcccattctgaaaaagtacctcatttattttcgagcctacatgtttattatctctttccgtgctccccacaacccagtctccaaatgtaagctccgtgagagtcaggactttgtgtgttctgtttcgctggtgtgtccctagtgcctagaacttcctggcacataatgagcattcagtaaacatttcacatatgactggctaactgctgagtaaggaaatgagtgaatgaatgaacaatggattaaaaatgtagatactttatcttagacaaaatttggcaacagtagaaatcaagacctttctctgtccagcttatgtgactctgttcaaaattatctcaattgtgtacaatattttgagctacaaacatttttctcctcaaaatctcatttttttcttttatttaggggaaggaaaaggcatagcagttgtttcctgaagcagttgttcccacatacacaagttgacacctcttttagcttttctgaccaagtttcaataatcatacacagaattttagaaataccttcttctggccatcctcccttgactcctgcttttccagtgggagatggagctgggaggtggtggtagaagaagggagagtgttgggggagtgagggaaggacctgtgtgaaaaggattggatttgaccatttagggaagggggacaatatgaaggccctgaaaaccagctattaatgatggggctcatttctgcacaggtaaatatatcagcactcatgccactaagatattttataaaaatgcttcctgaaacaaagtagttacttctaagtttccctagggaataacttttttaaaaattaaaaagatgcattcaacgtatgtgccataaatcctctatttttgataagcactgataactcaaagataatgctgctaatgtatagacaatttactttgttttcttcagagaaattgagaacttaggtcttgctttgtacacaaatacagaggtaacaaattctgataaagatgtgaatcatatttttttccactggttagtagagaggtagattgggaggaaagcattagatgtaatggcagctgtggcccgttcctggatgctaagcaaatctgtttcacatgtgaacatgttgggatcttttacattttgagaccgttttgcccttcttttaaaggtccttatagtctcataactcacagagaattatggtttagtttcagttaccagtaatattgtaaatatattcacatacatttttaaagacattatggcaatgtccttaattaataacatagccatcattttataaagagtcccaatttattaaaaataaaaccctaaaaccaaaaatgatgggataacatctttatgttgcccttgtttgcattcaggatgtttccaagtttatcatgtctgtgacctcagttacgtttacttccccagatggttttttaccacatgagcaattaatataattggagactatgaagtgtttatgtcaaggcaagaagcagtagcagcttcaatgtggtgactttgcaggcagtcaaacatatttcactgtgtgcttccaacctaacccttcccctgcccttccccttctatttttatattaaacagaaaaagagagttcacaaaggtgctcagaaactggcagtttctttcagaatgtggtatatttctaatttccatatatttccttcaagtggaatggccctgggagcacaattaccttcaatcttgacaggtataaaaaggccaatcctgccagtctctgattgaaatgttagatcaacttttctgaatctggcatgatgggtgacaaaagacagggatgttgctgggtcaggtgaagatgttgccataatcccttttacctattttgagcttctgagcaagaaaatcctatatcaaggtacattagcaccacctgctatcagcacccttagagaggctggcaacagagaggttctttaacttttataaccgtgctctacattaggagaggctcaaggaaagaaaaatcaggcataatctctgaagactttataatgagctcatgttctcattcttcatatagattccatttttctgtatgaaaatggtctgccaactgtccataattagccccatcttacttcacctggcaatatctagtgcttatgaattctgttggtagggaatatctttatgtggtgaatgcattctgcaaaaagtatacatcaaaaattgtaaatcatattacatcttaattacagaattgattcctctgaataataagcttataataaagccttgctagggtggtttcatatccttaaatccaaaatattgtgtttgttctttcactatcaatttgtatagactttatgtgacaataggtactctgaaaggggagcacacatatattaatttgcatttgatgacatactttttagaggtgcatttaaggtcttcccatttggtctggcaagttctgtctgcatggatctctcatccccaggatatttttagtgctccctctctgtttcttcctcttatctcccttcagagtccatcttgtcggggaagtcttctccgaccatctcatataaacctcccacccataccatgctttacttttctcctattacttataattacaaggcatattatgaacttattttctatcttccctgaactaaactctataaaactgggttttttctttaacttactgttgtatcttcagacctaggacagtgcctagcacatgtacacacagcacacatcacacacacacacacacactatataatgaatgcatggatatgtgaacaaaatgatgtgcttgagagggaatggtgtctataaaaccgccggtattatcagattcattttgtgtggttatgtttcctgaggagaaagagacgtattactgtttacttttggtttttatgtttatctgttataatagcatatggtatatctggtatatctaactgctcaagtcttaaatgtcttaaaaatattgattaatagatcctttaaataatatgattctaagactcatctgttctgatcatcataatactacaggggaaccacaagtcatcaaatggcatgaaactcaaaactacagaatgtaatctgggagacttataggcccaattttaataaaccacataatgtttttaaaatgtataatttcattgttaacatttgagaaattcagtatattgcacataaatatctggattcccagcctttcttgaatagcctgaacgtctgctgacgcgagacacctatgcctgcatggcatcagttagctggagctgaatgtgggtgtgttgaccgcagtcgccatcacacccttttgtctttccctcaccgcactcctatgtatattttgccaatatggcactgtcagtgtttggtgtggtatccctgctgtaaatcaagctaatccataggcatcacttcatgtgctgctctttatttatttactgaaatggagttgaaaatatttgttgaggttaaggaaaaactatgttctttgttgcactttaaacattctaaatattttggattagagaaaagaaaagggagcttatactaagtttttattttcctgaaaataatccataacttaatgttctatgtactgaaggagtttgggtgttcacaaatacacatatttatcaaaattcaatgaatgaatacttaacatttgtgcatttcattgtatgtaaatgtaatataaagtggaagcaaatgttgaactataattaatcatatgcatgcaaaagtatttaaggagaatttttctgtgtctgaaaatctctttgaaatgtaccaaaatcagatggattaaacaatggattgaaggatggttagattaatagatatgtgataaaagaagcacaatagaatagtcatgggagaatccaggtagtgggtacatcggattttactctacagttctttcaactttgctgcataattgaaaattttataataggatatagggtaaaataatctgcaattaaatatgacaattttcatactgttcctgctttctggaaagtttttttctaaactaaatgtacaattttacataatgaattaatgaaatggtaaattattataattttcagattctgctgtaggtttaattttaaaataatcttttattttaaaacaaccaattatgatttggagatgtaattatgggatttttaaatttttctgtattgtcccttttgtaccttattttcttcctctgtcctatacaatgatcaccccttattctcaaggcatacattccaagacccctagtggatgccagaaaccacagatagcaccaaaccctatatgtattatgttttcctatctgatgatgtaagtgactaatggactggtagtgtatacagagtggacatgctggacaaagtgatgattcaaatcccaggcaggacagaacagaacagcatgaaatttataactagttggcacaacatgcaatttataactatattttcacacaaccactctatctcaaataatattccctggtctctttaagttttacatcttttaagctcctatatgtagtttatgaattaattttaactggttattgttttactctacactttttaaggtgaagccatttaggattttaatgttttaatcatacatagtttttaaaataattggcatattgatataatgaaaagttctgtttttctctcatggactatttcttccatacatttagaaacttctattttacagttataaataggaggttgtagaactattaaaagtaacttaattgtaaatgcagatgctcctcaacttgcaatagggttatatcctgataatcataagttgaaaatatcattaagtcaaaaattttaagatagtattatatcaaaacaccacttacgttacaatatcagatgtctttgaagcacaagtccttctctctgtagataatacttagggaagatcatggatttcatttctcctcgttttctaacatttctctttcctatcagtctcctttgcatccagatgaagtcttatcaaaaagaatttccctcaaacttgtccatatcattacaatttagtagaccccaagtcagtcaattcaactaatattcactaaatgtctatttggctggcttcttcctgggaatctggacacaaataagacattatccctgctctaaaggaagtctcctgctcctataaaaggctaatgtggcaaaaagcagacactgacaaacattaagtggaggaatgttccatgttgatatactatccactttctgatgactcttttcgaaactattgttaggttgataaatatattcttggatatttattattaagtagctgaaataaaaatgattccttcttttttttttttttagaaaatagggtagggctcagcatgtgaattttgtttttaaatcattttaattttactttttatgggtggcagcatagtatggtagaatgagcaaaatgagtttaaaatcagacagattctgtcttctaatcttattaattcagtgatctagatctcagcaacttatttaaatctcccatgtctctcttttttcggctataaggcatgggtaatatagctatatgtgtgagaattaaaattttagtagaataatgagtaaaagtttcgagtccatatggtaggaacccagtaagtagtgagcactcttattattgttgcaatgatgatgatggtgataatgatgatgatttccatttgagttgcttgagaatcacaccctgagacaaagattctcctataagtaatttatgtgagaggtaatctcaaggaacactgataggggagtgaaaaagtagggcagagaaggaaaaaagccaataaggaaggcaactggagcttaatgatgctgtggcattctgagagtcaagtgtacagaatttcccactagagataagggagctggagtatttatccgtcaactcctggcagtcattagttgagggctactctgtgggggtattaattccttggcatttacagccttccacttgcataggcagagtggtgtttggcaggcagagaagctttcaggcaatgaaatacaagtgctaacagttggaagtcagctcggcctgcctgaaatggtaagagctgagggcatatgggtggagcactaatagtatctgtccagatgatgatgatgacgatgagaccacttgatgaagatgggaacactatattcactctctgagagatgaaatgtaagtgtagctgattaaatgtagggagaagcctgtctaggaaaaaagacactgtggtctctgcccactcatacacacaatttaccctacaggtttgagattattcttgcccaggccaatgaatcattttattgggcacagagttctatgcaggtatcctgtctggtacctgggtgggttttgggtattgttggctgctccttggatctgggagtccagttttcattcctctgaactcacttcctaaagctgtgtgcatttagctagcagccttggtctcaggtgatctagtcattacagcctacaggatcagattcagctgtaacccaaaggtcatgagcagaaggaacagctccaccagtcccttgcattgtttgaggagattttttaccatcttccagtttaattatgagatgtggcttctgggcaagaaagcaagtgagatctactttctgcattttgttttgttgataattgaatcatagtaattaagtaatcatgccgggtgtaagcaataacttttatgaacattaagatagtgcatttcataacatctaaatgctttgtttgttaaagttcacttttgagaaattgcaatcagtgttgggaaaacactattaatttgaaggtgtggaagagagagataaggtacctcatttagaattgtatatgtcaggtaactattatctctgggaagcagtgaaggtgtcttatttaataaatctcagaatctatacaagccataaaccagtatttacatatatgggtatagagatatctgtatacatgtgcacatatattattttagccatgttctagacacttaacaaagatgggattgcattgactggccgcttgtagtgtaaaagagaaaatgtaaactgtaatcagtgtttcatttaaatttataaatgcactgtattttttattttgatgaatgggaacaaattattaaggtaataatacattagctataactatgtttaaataagtccagggaatcaggtctccctattaattttcaaagtgtaagatgctatccatccacattgtagatattaggaactgttgaaactctatgtaaatatagtaaaaatttgttgcaaatggaaatatgaagtaattgctagaactttttttttgtattgatagcattaagtattaaggctagctgttgcagtagctataacctagttatagcaatatgcatgtggttgactggtatgtgctttgccacaaaatagaagaaagaatcctccaggagaaatattttgcaaatctgcttttcaacagtaattagaagatgggtgatattttgctactgttcataagtgtttctcttaatattttgactggttcaaaggaaagaagggccaatatccatcatatattgttagggaacatgttttaggattgcagagtgagaaaatagagactacatcttgctatccacattttccacttttctctcagacagatcctgattgtcatccctgtttagcctcctgcctttttactcaactcttccccctacctggatggcttttccttcttttgatcccaactttcccttcctttgatctcagctaaactccttcagttagcctacacttccatcttttattctctcaacttttcttttccatagggtcataattatactgcacataacttgggtatcctctaatcattacaaataatagccattgttcctagcaaaaatgtgtgtttatggcagcaattacattttatgtatctttggttagtccctgcacagtgttagcttatagtaggtgctcacccaatatctgtattttctcttttttttttcaagatctaaatacaattatatttttaaacgttgggtccaggctttacataaaaatatcatcctactttgccccctaagtttctaaaatatcacgtacttttcccccaacatctgcagccatccagaaatttgttggaaacttttttgcattattttaattcctaatccctgcctctttgggctcagtgacaaacaatcaaaaccaccaaaaatgtggttcactcgaagtcagatgagagagcctggctcaattaatcttataggatgtaagcagtgctgcatcaactggctccatgcaggagggacacgtgaaggatctcatcaaccagttatctatataatcctcatgataaatgtgcatgcatggcagaaactgaatcaggtccccataaacaaagtccatcatacagatcacatactcccagatctttgtttctgatctgatctatctcttccagggtcataaatcccttcaggcagatgttgtataaggcttattctttgagctgttgtattttgcttcagtcaactgagctgcaaatcgagtctggctaggtgttggatggtagagcaaaactggaactttttcctgatgtgacagcagtggctcctgatctggctgtctcctcgccagagctagcctggtgggactgagatacgtgaagcagagagatgtcatccgaggagtggaattatcagactgcactgtaattgcttgttgaatcagttatctgttattgcttaacaaaccactccaaaacttggtggcttaaaacaacttactatttcccatgatcctgtagcttggttgggctcagctgggagattctcctcgattgtgtacctgaggtcactcatacagttgcattcagctgagaacttaagaggggctggaatttccaaaatggcttctctttttccagcgtctcctctgtatggctctaatcatcctgcagtctcgtgtggacttggcatcaccatgctgggctccaagatgggggagtgaaagtaccagtcctcctgagggatagagtagtaatcccagatattacttccactgcatttggttgctcaaagcaaatcaaaaggccaactcagaattaaagtgatggtaaaatagactacacctcttgataagaggagaggcaaagccacgtcgcaaaggggcttgtgtaaaaaattggaggaattattggggccatatttggagacttggccccttcacattttgtatctgactttctcataagacttttatttcttcagagcaagggctatgccttcttcacgttttcagaatcagagtatgaaaaatatttgctgtttcttgagtaaatgattactccatgatagttttccctctaccccaactgccaattataaactcagatttacattcagaatactggtgtgaagcatttctactatatctttttttttcaatcattttcaccttttgcatttatcttataaatctaacactataaaatacattatctggccgggcgcggtggctcacgcctgtaatcccagcactttgggaggctgaggcgggcggatcacgaggtcaggagatcgagaccatcccggctaaaacggtgaaaccccgtctctactaaaaatacaaaaaattagccgggcgtagtggcgggcgcctgttgtcccagctacttgggaggctgaggcgggagaatggcgtgaacccgggaggcggagcttgcagtgagccgagatcccgccactgcactccagcctgggcgacagagtgagactccgtctcaaaaaaaaaaaaaaaaaaaaaatacattatcttagttttttttttttagattagaatgctggcaattcactgggaagtgatccctggaagtattaaatgaacagaggagtgggagaagtaaaaaagggaatggatgaggctaaaaaaagggtgacaagcaaattaacctggagcaactggggttgtttctactggggaactctgcacgtgcctcggagctatcccacctgaagggtgagagcactggaggacatgaatttcccagaagttatggtgctccatgattacaggcaaagcaagcccactctagtggccagagagagccctcaggcaaagagacacatgttctagaagtcataccaacagcactgaatggtccaagtcatggagatctgggcagtgcaccagcaatgactgccatgcacaccattctcgtctgagacattatcagagaacaaaccacactcaatttattggtggtatcaagtatctaatgagtttataggctgggctagaatctatatttggggggagaggaggaattacttaagaaggtagtttcttcatatgttctttgacccctttaactgttaatatcatattgtcctaacaaaataatgaaatagaaaaaagtagacctaagaataaatactgtatatactagttttcttttaaattaaaattattaatgtgttttgtaaactgttcttatcacctgttttatatgtaaataagtaatatttttacatcaagcatttttaattgtttattgccttgctgtaaaattgattgttatgattattttagtaatttttatgtgatttcttttaaatcacatagggataattatgcttggcagattacttctacttttttttttcagatgttttcaaggcagagtcagaattaataaattttagccctctgcccaatccatgataagaaggtaagatttagtcattgattcactcagcatttaccaggtatttatcttatgtcagtcactgtgctaggtgctagagatgcaaaaaggaatacaatgtgatctttgcccttgaaaaactcaaatcttagagtcattcaaatatcactgtggtgaaatctcttaatttatcaccattgttagtaatgcatagtattactgacacattgataaccattttcatatcaatcacacctttttataaccataaccattttcatatgaattacaccttttttttttttttaagatggagtcttgctctgtcacccaggctggagtgcagtggtgccatcttggctcactgcaacctccacctcccaggttcaagcaattcttctgcctcctgagtagctgggattacaggcgggtgccaccatgtccagctaatttttgtatttttagtatagacggggtttcaccatgttggccagtctggtctggaactcctgacctcaggtgatccgcctgcctcggcttcccaaagtgttgggattacaggtgtgagccactgcacccagcccaattacacctttaagcccatgtagtcaatcattcagctccacctctaatttaatggccttcctttccctgtcccttccttcccttccctgtctcttccttcactttccttcccttctctttctgctatagactgaatgtttgtgtccctctgaaaatttttatgttgaaatcctaataccctatgtgattgtattaggaggtggggcctttggaagataattaggtcatttggagacctccctccctcttcagccatgcgaggtcacagtgagaagagaagacataagtctgtgaaccagaaagcagtctctcaccagacaccaaatctgccagtgccttgaacttagacgttcctaccaccagaactgtgagaaataaatttccccctcctactaaatagttttagctaaaaggagtaccaagaaaagccctgtctcctatttggaaagaaacataagggctttggactctaaattcacaaaagcagcatttatagtttacatctattgttgcacatcattgtaactccagtgcctggaaaagtatctgatcatagtcagtattcaatggccttaggtggaaactgaaagcaaggaggcatagtagagtgtgattagaggtgttgactggagatttgcatgttttatcagtagcagtttttttttttttttgaggcctaatgatgctctgcttcctcatgaatttcattccaaatgaagacagtaactaattgcattattttttgaactgcttatatttgctgttaccctttcttttatgcagaagatattcaagttggagagggaaattatgatttttttttcctttttcaatgaatgtaactgttaataggtttggatgagtaacttctgtgatataaggtctccgtacaagcagttatcatgctctgtcagtctttctatgcaattttatcatgtagattgttttgggaaacatgaaaattaagatttaatttgtcctaggaattggatccaaaatgtaatggaattggttccttaatgcagtgcatagttgtagagtatagtgtaaattaaatcaacttgtgcttcaataatctctttattagttttcaaatattgatttaaataatgatattaaattgtgtatagttgaaaagatggcattgctttcactgcaatagatgaatgtcatgaaaatgttcttctcttgtaatggaatcagatgtagaacatgataaagaacagttctcttcacacctcataatttctgacatagtaagttatgttgaggaaaataggcacattatattgacaatatatttttgtttacaaatatgccaggtggcctggtgtacagattgattgagggtgatcactactgcccatcacaactattaccttttgcaaagatggccgaagtggaagggaaaacttccctgcacaacttttgtggtggattactgttgagatatagctatgcattggatgttttggaaaaggaatatataagaatagacctttgtatttattgaggaaaattaaaattataaaagataaaaaggcaacttaatattctctcatttaaattttaattaactttcaattttgaatggtgttttcctgagctgttatccagtttctgctctaaagttggctgtaattttataacattcttttgatgactgtatgtgcatgaatatgtctgtagttattttgaaggtaaaactctacttatttcacttttttgagtgaagtattaaattgttttcaagatagcagtgactgaatattgcacttaatacaaatgtttaatttctttaatcctttttacagataaaagtatatgctttttatccttttccttaaaatgacaaaggcttctcctcagggagatcagaaagcataatgactggcatgctgaacctggtatctgaacatttgttttttattctttatttcatgtgaccttggaataattcagtggctcctagattttctcaaaaatgactcaatttttcattcatttcatttaaatgaccctttgagttatctcgtatgctacctgtttttatctttataatacagtaaaatttaaactattcatatctctatgtgggggtgggggtgggggcagataagggtcatagagaaggcacctctttctcagaaaagtagcaaatgaccaccctccatcccaaaatagatttagctacaagaagagtaaagtgcacatggaagaacaaaaaagccttttggtgtacaaggatttcagactttgttgggcttcagcatcagtagagagtcttattaaaaacactgtcatacatcacttaaagacaaggatatgttctgaaaaaaacagatcattaggcaattatgttgttgtgtgaacatcatagagtgaaccgacaaaagcctagatgggatagcctactatgtacctaggctatatggtatagcctgctgctcctaggctacaaacttgtacagcatgttactgtagtgaatactgtaggcaattgtaacaaaatggtaagtattgtgtgtctaagcatatctaaacatagaaaaggtacagtaaaaatttgacacaaaagattaagaaatggtaattgtgtatagggcacttaccatgaatggagcttgcaggactgaaagttgctttggatgagtcagtgagttagtggtgagtgaatgtgaaggactaggacattgctgtatactactgtagacttttataaacacagtgaacttaggctacgttaaatgtattaaaaatattttttctttccccaataataaattaactatagcttattgtaacttttttatgttatatacttttaattatttttaacttttttactattttgtaataatacttagattaaaacacaaatacattgtacagttgtacaaaatttttttctttatatccttattttataagcttttttctatattaaaatttctttttttttacttaatttttttttgttaaaaactaatacagaaacactcacactagtccaggcatacacaggaccagggtcatcaatatcactgtcttccacctccacatcttttcccagtggaatgtcttcagggccaatacatgcatggaactgtcatctcctatgataatagtgtcttcttctggaatacctcctaaaggacctgcctgaggctgttttctagttaacttttttttttttttttttttagtaagtagaagaattatactctgaaacagcaatcaatagtatggtagatacagaaagcagtaacatagtctttcattatcaattattatgtactgtaaataattgtatgtactatacttttgtatgactggcagcacagtaggtttgtttacatcagtatcattcattgtgctatgatgtcatgatggctatggcatttctatgcaatgggaacttttcagctccactataatcttatgggatcaccttgtatatgcagtccatcaatgatcaaaatgttatgtagtgcatgactgcacctactccaaaactacagaagtggaatttagagtcatgggaagctggataatgaccatcaaagttggtcttacatgaggtaggacctggtccaatttgaagtaagaaatcagggaactttccttcaacacttatttccttccatggtctaagacatttcaaaattctgagcatggttttccatttatcacagagtttaagttactattcagtgttgaaattcctggccctcaatggcattatgaatcagctgttcatagaactcaactttcttgaatgggccatttcccaggtcttctacagctgttttgctcatttttaatcccttcatttgccagcttaatatttgctagctgctgttattggggaattcagtttttcccccatgtccctatcttttgccagtttttctcttcattcctcaaaatcagtagttctcctttctcaaaggttgcctatgaatcatccatgatttgtatatcaccctttgggaaacacgaatattttcagaaccctcatttctctgtcgttaaatgaggtcaataatgactgctgacgtttcctttgactctgaagggcgtggtcaggctagatgagaaaattcttacagaatgtggtgtgctgtgctgctgtcgccactttgctgggagactgaagctcagacagctaagcgatttgccagggctgtgcaacccatctgtggtgggaattccagaattccaacctggagaatctgacttactcttttggagaacattatatttgataaactggaatcattgttttgagtgctcccatggctctgtaggccaaaacagtagaacttatgacagtagtttggtcttcaggaactccacttaaccccaaactaccctccagttttcagagagcactggggaaaagggagggatgagtgtgtattgaattatctgaattctgccacttatgcctaagagatatgtatgagagaatctttacattttgtacacattattctaaaattccttttagtccttaaacaactctcagggggaaaatagtacagaattaaaataaaagttcttaacatttgtccctgaatatatttttagaaaaagtatacttgaaatctgatcacctataaggaaagatttatcaggagagtttaaatttttatatttactcatattaaatgcatgtgtgttttgagaccaaggttttttgtttgttttaatattttggggagacatacttccttcaaatatataggttagaggtagggggtagggatggttagtggtataaaaaaaaacagaaagaatgaataagacatactgtttgatagtacagcaaggtgactgtagtcaacaatgacttaattgtatattttaaaaaactacaagagtgtaattgggttagggtttgtaacacaaagaataaatgcttgaggggagggataccccattctccatgatgtgattattttacattgcatatgcccgtatcaaaacatctcatgtactccacaaacatatacactatgtacccccaaaaacttaaagaatatataagtttaaattagaattcccccaaattctagtagtagaatatattcttttaaaattctagtagaatttgggagaattctaatttaaaccaattctggtgttcctgagttatgtgagctcctccaagttccactgttttgtcattgccaactcagggagtcaaatatgtacttatttagcattttctgagccaggtactggctctgagaggtacatactttcatttaattcttcaagagaattaaaagcaaacggagcccatatgttatagacaaggaaactgaggttctgagatgttgagtagcttactcaaggttgacctgagactctaaattaggttcatcctccttgaagacacctatattccttttgttctcataaaatagcacatccagccagcattccatcccagatattggcactaaggagaggcgtgggaaagggcatggacactttctgttaggtacatgggggacgttgtgctctagcttatacatgactgtaaaggcgcaaatgaaaactcttcctttattagtacattttcttttgcatggttatctgggatgagtatgtggtgaggtggggctgtgggaggaagctgctgcaattagttttgcctcaggtagaatgctgacatcagttgtaatgagattaaaatcttctactcagctgttgcttgaaatattctattgtgttctcatccaactattttaactaattgaagtgacttaaccatataattattttcaaatgtttacaattacttttagataaatataaatgaatgtttgcctgcatatgaacaacaaaaggaataatctggtaccttcacccaaatagtcaaaccctctaagatattggtagaaacatcagagtgtatcagtgaaggtcaaaggacacaaataggcatttttaaatactaaaatgaaatattactttcagttccaccaaaatggagtagcctcattccttccgggttctctcccttataactaaaaatttctagatacagtgctacgaagatggcaaggaagtctctcaaagatcaaaagaagagggtgaactgctaggaatttttggaacttgaactacaaagcagtgagttccttgaatttttgtgttatctgtcatatatcctgagctaggtgctacagaagcctccaaactgccagaactgccagaaagtacagataaagaagctccaagaaagtcttgttttctttaggcaaaggaccaggtgaagggtggctttacaccagaaaatttttggcagtatctgccaaacaccactggaaaactcacatcttactccctccatgatttcagtggtgctaaacagaatttgatcccgtcattcccatacattgatactgttagacttgatgagttacatgggtatattgttattttctagagcagctgctaggaaaactatccaaagcaatatacttttgaaaagataaagaaatcaagatagaaatttttaatatgatcaagtcacccaaaggaaagtaagagaaacagaggaaacaaagagaaaacaagtaataaaatgacagtcttaagccctagtatgttaataaacccaattttattactttaaatttaaatgatctatggaaatgcaagggacccaggatagtttaaacagttttgaaatgaaagaaccaagtttgaatacttagattttctgattttaaaactgtaaaactatggtaatgaagacaacatggggctggcctaaggataaacagatagattgatggaatagaattaagagtccagaaataaagccttccattgatgtccaattgatttgcaaccagagtgccaagacaattcaatgggagaaagaatagtgtttttgacaaatggtactgggttaactggatatccacatgcaaaagaatgaagttagatcccttccttacaccatatataaaaattaactccgaatggatcatagatctaagtggaagaactaaagctataaaactctcagaagaaagcataggtgtaaaattcatgaccttgcgcaatgaattcttagatatgataccaaaagtacaagcactgacaacaaaaagaaagatacatacactggactttatctaaattgaaacttttgtgtttcaaatcacaccacaaagaaagtaaaatacaggtcacaaaatgggagaaaatatttgtaaagcatacatctgataagaaacttgtatccaaaatacataaagtactcatatacctcattaattaaaagacagataacacaattttggattaggcaagggttctgaatagatatttctccatataagttattcaaattgctaataagcacatgaaaagatgctgaacatcattagctctcagggaaatgtaaatcaaaaccacaatgagaagccactttcattcagtaggatagctattaccaaaaaagacagataataagaattgttgaccaagataaggagaaattagaacacttacccattgctggtgggattgtaagatggtgcagtcactgtgaaaaatggtatagcagttcatcaaattgttaaacatagaattactatattagctggcaattctactcataggtatatacccaagagattaaaaaaatttacataaaaacttgcacattaattttcataccagtgttattcataatagccccaaaatggaacaacttaaatgtccatcatctcatgaatggataaacaaaatatatccataaaatggaaaattgttcatgcttaaaaaggaatcaagtactgatacaagacaaatgaactttggaaaacttacgctgaatgaaaaaaaagctagtcataaaagactacatattgtatgattccatttatatgaaatgtctagaataggcaaatctgtagaggccgtaagcagattactgattgttgggggaaatagggagtgaatacaaatggcatgagtttctttggcggatgaagaaaatgttcagaaattgattgtggtgatggttgaaagagtctatgaacatacaaaaaccatttaatcgtgtatttttaaagggcctggtatgtgaatcaataaagctaaaaatgtaaatggtctaaataaactaattaaaagacagattttgacataatagataaaaaacatgacccaaccatatgctgtctataaaaaatttgcttcaaatacaacaatataggtaggtagaaagtaaaagcatggaaaaatatataccatgtaaacatgaatttaagaaaaaaattgttatattcttaccgataaacttcagaggagagaaacattattagagctaaagagagacattgtataattataaaaagaacaatttatcaggaaaacataactattgcaaatgtgtgcacatcaaataatagtgcctggaaatatgtgaagcaaaatgaaacattacatctaaattttcttaaattctttaaaccttactccacgtataatagtctttaattatggcataaactaaaagatttatgtctatactaagtttcattcctgaaagagctgcttctgtctttttatcctcaaaatacaatactgtattaggtattgaagtgtttgtgtatgtgtatgtgtgtatttataccatatagacaaggtctatgattctgtaatcatagaacttacagtgatgtgatccttttcaagcttcatattataacacacacacagacacaaagattcacaaatgtactgaatcgatttaattccatgagttgtaacgttcttgataccatatttgttctaaagcagcatttcttagtaattaaaatgaatgagaagatctctacctaaagagatagtatgaactttaaaagcagaagcagagttcagtatttatatttggtagcaataaactacctgttagaaatatttatcaagtgaagatataattgcctgctttgtctgtgaacctcataagtacaaaaattgtgttctttgaatttacactttttaagggatgtatgttaaacattttagcagtgtatttttttaaattaaaatatatgaatttaatttacacaaataatttattttacataaaaacattctagctagcatctagcagttttaataccttatacattttaatcatatctgctagaacaagtaatctctagagtggtcagctatggaagaggataaagttagtagacctactaactttatagctcatatatattttggttatatactcgaattcctattactcgatgcttcaagcattatcttttaacctctgtatacaaaattagaatgtcagcacgtttacacttttctacttgttctccctctactttctgtttttataacttactgatactaaaatgttcaaagcttatagtatttttatgttctgtaactataattctcacacttttttctttagttatatacataaatcattttagggctgacctccaaatttttacaatagactctccattctataagttgactggaataatttctaacaacatgaatcatgcatgacttgtacataccctttgggaaataccaggattctcagaggttttacttgtgtcattaaatggagactgtaatggctgctaccatttctcttctctgtctctccggtgtgaaacagggctcaggggtacacataaggctgcaatctggtcctttttcttttctctatctattcacatttctctttgttttgacctcctgaatgtgaaaatgtttaatagcatgtatatttacatatttaagtattcaagctctactgcttagttcttaatagtatcttacctgtgcattttcaccagccaaagattttgagaggacaaaagaggggacaagaacttgctatccgttttaaagaattttctatagagaccttttaaaagtaagatgattaggatttcattaaaaagaattttaaatatgttaaaagcatgagtttttgcagctgctaggcagaaagacttgcttgctaaccacactttgtttcttgggaatgaatgactgtacttaatgtacacacacacacacacacacacacacacacaggtgcacgcatgtgtgtatacatgcccggatatacaggaactaaagataggataaaaaactgacctctagaatattcagatacagacatcattctgtggctgcctcaccaaatcatatgtggttggatataagaaagtacagcctatttctgggatttacagagataagaaaagggaaaaataggaaattttaaaatgtcacaactcattttattaatgattattactcagctttattattttagatagtaatgcatttcatgtttgaatatcacaaagaaaacttttctgaagtgattttcttgagaatattgttatacatgttttctgcatcctcccataggtctatgaacataagagtttatcatattttacctatcctgttaccactacctgtggacagtgttaattgatttctaggaaatgccgacacttattttagcactaatttcacagagtcatttatttccaaggtttatataacagtaaataaactaataaaatatattgaattttaatttgcctttttacctcttaatttctctcttatgaatagactttagaatttgaccttattaatatactaggaaactcagaaattagtttcatgaaataatgtttgatttattttcattcatttgataggacaggagctttaacagatggactgtcagatccaaataaagttttattgctttattgttatgtgcaataattaagatattgttcagatagattgacacctagactctgggagacttatggtgtggtggtgtctagatagaggtatatggagaattcgtaatactgcatgtgtaccaaagaacacctgtattgttataatttgtatgtaaattgtatatgaacaattgtttataatctaaagtaatattatttagaagcattttattacatttatttttagatttgtaacctgattagaagactaactttttcaaatttttctttttaaatgtcttgatttttgagaaattttagttcactcttaagttcccttaagattatggagtagaaaccactgtaagcttaggaaaatattttgaaataatttgtgaaatacctttttgtatcccaataatttctattgtcatgagcttttgaatgttaacaaaatgattttcatctctatgttaggtttaggtgcagggtatacaaatgttatatttttattttcagtacagtacaggattctacaggggttttcattgttcatttggggggtaaactttttatttccttttctaatagctaagaggtataaattttgatggtattattatctcagtttacatatgtttcacttgtaaatattgcattcatgaagaagaaacaccacaacaatttaaacacataaaatacttcatgtgagttacttgaaaatgacaaatcgaaatctgtcacgtaataggaaaactatgctttgaagcataatctctagtgctgcctcttctctattacagcttaaactgtactctgcatgtcatacataaagaatgaactttgcagtcagttaaaaaagctgaaacaattggtatgagaaacataccaagaaaatattctaatcataattccaagttgaggtcaaaaaaataaataaaccagaatatgagccataatctttttattttttttaactttaatagtccttagcaataatcaacaatttactgattcaacaggagacatgttactctactgccatctggttattctaaatagaacctatccctctggacgagcaaaaggcgtaatgattggatagacgttttggcagaaaaaagacttttttaatgtcttgggatttgggaggtaaaaccaatggccataattttgaaacatctgctcttttcatgatctcgtctacatggaaagagatttggaaacagaacatcctcaagcattatttttttgcagtgataaaaaaatttcattttgtctaaatatgtaagtagagtcaaattcacttcttagtaaaacctattataccattatataaacatgtagcttgcttcttcttttgaattcaacattatcttaagttggtatatttattgtttatacatctacctacaaccaaaaaggtgaggagttttacacaaaaagagtatagatataatttttaaaaattgttaagtaacacttgacagcaaaaggatgattgcacccacaacacatttgtcagggatagcaactgtagttggcaacaaaaatgaggcctatatgctccaaccctgggtcatctttctactgtttgaaattggtatccaactatctattggatgaatgtccttcttatggaaataagaagtgagattttcagtcaatcaccctagaccctaaattggttaaatttaaaaatgaatgggcctgctctcctccttcttgctgggtctcttggcttcctgggttgtttccatcctttctcattctttctttcccctcagagtcagggactctagaggaaaacctttctctggatttgttgcctgtcgtgttcttgccagtcctcttctggggatatgctagattctggttttgtgctcttttgccttgcttagtatgaacttatggaaatttggtctggtctgagctttctgagccctgtgtctgccccattcctcctggatctgatttaccttctatctcagcattggcataaaatgagtcaggacctgcagtcacacctttacttgggctagattagactgtagaccttaccattgcaggagtagggtggaattgacctcaattctgccctcacattccagccctcctaattgattttccaccagcatcttccccaggttgttccctcctcctctgcctgtatgactgactggcagcatgaagctagggtacgttagtccctggtagggggcaaagttcttgcacaagtttccaggaagccaagtccaaaagaaaaaaagacacaagagtatggtaatatgcaggggagaaagaacgtctccaaaagggaatggaatttatttttagatctagaaaaatgtcttcattattttaataagtaaaatatttaaacgttagcagttataagcaccactacatatctattagagtggctaagattgaaatatgctgacagtaccaaagtctggtgagagtgcagagaaactggacatcaaggagtttggcagttactctttttaaaaagaaaaaaaattagttaaactttttattttgagataattgttggttcatatgcagttgtaaggaacaatgagatcccatttatgcttgactcagtttcccccaatggtaacattttctgaattacagttcaatatcaattctataatttctatttggttctttttttataagttctatttcttttcaaataaattctagtttttcatttgtaaagctatatagtgcagtatcactgccaggttattaacattgacagtcaagctatgcaatcctatcaaattaccaacatcgtttttcccagaattagaaaaaacaatcctaaaattcatgtggaatcaaaaaagaacctgaatagtgaaagcaatcgtaagcaaaaaggataaagctggtggtgttacattacttgacttctaactatactacaaggtatagtacccaaaacagcatggtactggtataaaactagacacagatcaatggaacagaaagagaacccaaaaataaggctacatacctacaagtacctgatatttgataaagtcaacacagatatacactggggaatgaacatcttattcaataaatggtgctgggagaattggagaaccgtatgcagaagaatgaaactggacccctatcttgtactgtatataaaaattaactaaatatggaccaaagacttaaatgtaagaccaaaaccaataaaagtcccagaagaaaacctaggaaaaactctattggatattgtcctaagcatagacaaagagtttatgactaagtcctcagaaaaacaacaaaaacgaaaatagaaaaattagacttaattaaatgcaaaagcttctgcacagctaaagaaataattaacagagtaaaaagacaacatatagaatgggagaaaatatttgcaaacaatgcatctggacaaaggtctaatatccagaatctacaaagaactcaaataactcaacaagaaaaaaacaaataactctgttaaaaagtgggcaaaggacatgaacagacatatttcaaaagaagacatacaagcacccaacaaacatgaaaaaatgctcaacatcactaatcatcagggaaatgcaaattaaagccacaataccatttcacaacagtcagaatagctattaaaaagtcaaaagcaatacatgttggcaaggatgtagagaaaagaaaattcttatacactgtcggtgggaaggtaaattgtgcaacctctttagaaaactgtggagatttctcaaagaactaaaaatagaactatcatactatccatgtatcctacttctgggtatgtatccaaaggaaaataaatcattatatcaaaaagacccctgtgttcatatgcttattgcagcaccattcacaaaagcagagtcatggaatcaacctaaatgttgatcgaggaatgactggataaaaatatggcatatatataccatggaatactactctgccataaaaaagaatgaaatcatgtcttttgcagcaacatggatagaacaggagaccattatcctaactgaaatgactcagaaacagaaagtcaaaaaccacatgttctcacttacaggtgagagctaaacaatggacatacatggacatgcagagtggaataatagacattgtggactccaaatggtgggaagatgggaaggtgagaaggggccaagggataaaatactacctattgggtacaatgtgcactatttgggtgataggtacaacaaaagcccaggctttaccactacaccctatatccatgtaacacaactgaacttatactcctgaatctataaaaatgtaaaaaaaaaaatttttttttaaaacgtaacactttcatcaccacaaggattcctcttgttttccttttgtagccacattcatttccctcccacccctccctctctttaaaccttttgtcatttcaagaatgttatataaatagaaggatataatgtaaacctttgggattggcttttttcccctcagcatgaatctcggaaaattcctctagattgttgcatgtttcaatagttggttcttacaagtcctaaactattctaaaatcaaaatttgtcaacaataatatttttaaacagtgctaacgtaacaatgttattaaagttcttaaaaaatgttgaaattttcttctacataaaaagttaaacattttatatggtgtgttgattattctccatttactctcctcctactctaagtccccctgcctttctctggcttgctgcatgacccaaggggcttacttttatgcagtgtatcatctgggcccctcctcttccacatatccggctcaacagagtttagttccttcctttctttttacccctaagacctagaggttgagacagcattttcttattgttggaagatttgttgatgcctttaatcttcctgcatctttggacatggctcctttatttaattcctttcactcaaagttaaaagcctttgagtgtactatctgtttcctgccaggaccctgatacatttaacaaaaaatagataaattggatgacaaatgatatactgggcaaatatttgtaactcgtgtgataaatataggtttattttccataatatacaaagagttcctacaaaaggaaaataaaaaaccaaatgaccaaaagaaaaatgggcaaagggcatgaacaagcatgttacagaagacaaattccaaatggtcaataaacgtgaaaatatgcttctgcattagtattcagagaaattcgtatttctgtagtcctagctactgggaaggctgagtcaggaggatcacttgagcccaggagttctaggcttctgtgtgttatgatcatgcttataaatagccaatgcactccagcttggcagcataacaggtccccacctcaaaaaaaaaattaggattgctgagtcaaaagttatgtgtttgtctttttaactgattatgtgagattgctttaaaaagacattgcaacaatttacactaaagcaacaagatacatttttcaaccgtaagatgggtcagattcccctttaggactgaagcactctcccttctgctgagagtttggtcaggcaataattttcagctgattccttctccaagaattttcctcagagacagctgccttgcctaagattatggcctctccctgaggatggcctgccagcaattactcatgatgtaacatacgaaagtccaactgccttgcctgtaggttggaaaactctaaagggctattttccagggaacccaaaccacagcacagcattaacacttaccatgtgtaatccttaggaacataggaattctaatagtataaattgttgcaatgtctttttaaagcaatctcacataatcagttaaaaagacaaacacataaattttgactcagcgattctaatttttttttttgaggtggggtcctgttattttgcccaagctggagtgcagtgactatttataagcatgatcattgcacacagaagcctggaactcctgggctccagtgatccttttgcctcagactccctagtagctaggactacaggtgtgtgccaccacacctggctttagcaatcctaattgtcagaatatttgagaattaaaaattagaaagcattagtacataaatatatatatgtataaatgatgtgcactgctattttatttgttggaataactgaaaaaggcttaaatatccatcaatagatgaatgatctaccaatagaggatattgtatgttgggatattttgatagtattaaaaagaatgagctagatccatatttaatgggatgtggaggatgtccaaatgtcaatgatacagtgttgtataaaaataaaagaagaaaaacaagttatagatttatgttggcttgtgtgcatgcgtgtgccctgctatagcttattaaaggtcaacagatctcagtgactgttagaatgacgtgttttattgggctcactcttcagccagaacatgctagcatggctatacttgttatttatggtgatgaccattttgattggctgggtattttttctaattaggcagtgcctgtgctgtccttgttgttaattattttgatggttggctcctcctttaaagtgtattgtcagctgactgacaatttttgaaagcctgtttatgtagttggcttcagaagcagcaaggattcaataaaccacttttatattcagattatgccagatatttggatggaaaagggagtattcattccagatattatatctgtataacaaatataaacaagttagaattataatcaaaacttctaattctatctgttaagctctttgtagacactccctcttcattatgaataacataggtaaggagagagaaattatgcattatatagttaaacactggcaaaacattatttctcattctcctactattggcttctgggttaccagagcacatacttaggactgccaaattctgaagtttagaaaacactgtcataaggcataatgtatccattagaaatgcattaggaaaagagagaagtaacattttattagggcttttagctagttggtggagtaataagcatacttttgtgttacctttatatgatttatattacttttcttctagagaaaacagtggaatcaaagagtattttgatcagttttataaagaaatagatgactacttaagaaataaatatattcaggttagagtttgctcatttgtatttgatatgatctgacactgcagaaggccaaaggatctcattattgcccgggtctttacaagaaaggttccccaatgcatgacatggcaatttgtcgcctttatttagagggatttagacaaagcttgcagcatttagcattccgttcctttgacagtaccttttaacatccttcttattgttctatttgtgggtcaatgcaaagcattcatgaagattttgtggtttagggagcaagtgaggctgttgtctaatttgttgtaattgctcaacttactcaaatagtttaatttacctctgaatatgttcagcagcttagaagaaaggtgtttgttcaaacatgaaatctttataattagaaaaaaattattatatgggtttgtgttatgtaaaccttagtgaactttctcccaatctaatttaattaatctttaaataacattggtttagttcttttggcataggggcaaggaaatattatgctttgaaaatgtaggcttttctgagaagtaacatacatttttctacgtgagcgactttttccttaaatctctttctaaacagtcatttcaacttctgcctgagggaatggattagctgtatcattcctcactctcagattaaccccctccctgcaaactgctacagccccagtcagcattaaggttaccaaaccatgagggaggacacaaaatgttctttctctttccaactcaatctatctttgaagtgccaaggagagatattctggcagtacgtaaatctgaaattctgttttgcttcaaaaaaacaaaaatgaaattctcactcagccatgattctcttacaaccggcaatctttttctgtcctttgtctacctcagtgtcttggaggtgtctcattagtgggctggtatttctgacagaatgctttttaagagttacatttctagctaaatctatgctgcatttttagagacaaaatagcatacagggaaaatgaaaaataacaccagagtcttgaataatatcgttagctcaccttccatcagttaattgtatttcttctcttaaaaaaaactattaaaacttcaatttcacattatattgctttcacaaatacattggctaatagtatagatattgagccattactgaaaatgaatttttgtgggtagaatttgcaaccaggaagaatattaaaaaactgaatactttgtattcctgtgtgcctattcagtatcctccacaacccagcatcattctttggtgaagaaattgtttactatacttgggttagcaacatttaggtccccccaccttttttttttctctttcaatttttagggatgctgaaattaggtgtgagtgttgataatgactgtttctgcctctgcttatataatcaaagtaaaatggagttaggttaagttattttagagggagcttactatcttctgtgtggccaaatttatccaggagcttaaactttagatactttgggtcccgggactagcatagactgtgaagcgtagagctgtgaaagaatttggatcctaagggaaaaaagtttggaaaccaaccatagaaaatgcaagtgcaaaccacaaagaatagttaaaatgaaaaaaaaggggcagtgtaaagcatgggaggaactgagattcttttcctctgctgttggaagttctaccacatcagaaacatatttggtaatagaactaaagctaaatatatagctatcctctaactagcaattccatttctaagtctataaccaacagaaatgaatctatatgttcatcaacatgtgcaagaatgtgcatagctgcacttagtaatagtcccaaagtggaaacaacagtacaatagatgcattaattgtggtacactattacaaaaaatacagaaaaaaggatgagacaactgtacgtatatacaacggcatggattaatttcacaagctcaatgttgagtgaaagaaaccactggataccagtaagaacattctattgttcaatttgtgtaaacttcaaaagcaggttaaactgatctgtggtgttgtaagttaggatggtggttagcattattgttggagggtgagtagtaatgacaagaagaggaccttcttgagtgctggtggtctgtttcttgatctaggtgttggttacctgagtatgttcactttatgatttgtacaatttgctgtgtgtgtgtttactccaataagaaagattaaaaagaaagaaggaagaaaaatcagctatagaaatgaagaggattggcagtgtaaaagtgtcatttttttttccccatggtaaaagattaagaaagagatacatgattaaagccaatgaaaatttgggagtcaaagttttaaactctcttagcagccaaactaattgtttgaataaaatgcatgctagttatcacagtgtttcaaactttcctgatccttagaacactaaggaagatagtctcaaaaatatttactccctggtccttctgtgggagatttcagtttagtctgtttaagatggggctaggaatctttattttaaaaacacaacttagacaagaattagaataatggtcagttcaaaagagggaaacagaattatgtgatttttttttacagcagccaagaatgatgtagcctggtttattcctacttctccttcatctaccccaatcctcccacgtatctccaattccaatttgagcagtgattctgaaactttactttaagcacttgttaagaatgcagatatcttggccttactccaaggattttgaattggtaagtctgaggagaggcccaaatagggctatgcatttttcataagtaccttcgaagatgctcagattcagaagcagttggtctcagatgtacaccttgagaaagtcaggcctggagaaaaagaatgtactagacaaacagatatatttggcttagtttttttcctttcatgactgggctggttatctagcactggttatatttaagtccctaataaattttaaggtcataggagatgaggagtgtatcttatatccttcttaggagcaatttcacagcacctgtaattgtactgcttagccagtaggtatttttgaaagtcatgaagtccagatgattaaagttatttttagttttattataatcatggttggaaattaacctggaaagcactgagtttccctgtgtgtatatatatcacttgtaattaaaaagtaatctatttccccagtcattaaatgtttattgagtatctattatgtactggttttctgaaatatcattttgtccctgtcatttcatggtctctagttggagcatgcgtagcaaagaaaattcatgttccaaaatggcacaaggagggtcttaagcatttttaatattccacttatcagaattggaatatagataagtatttgcctgctcccagttctttgataggcattctattaaaatcaaaggcaaatgaattgtcagaaatagatttagcttacaatatagatccactagtccttgcaagttggagtcacgggctagttctacaattaagaaagaccaattattcaatctcttagaaacttagcttacctaataccttgtctttatgtattatgtaattgtttttattctaggagaaggtactttattagttcaagactgcccagatatacagtaatgaaaaagaagaaaaaggctatcatcactctaataaaatgattagttatgttcggtttggaagtgtttgctcaatatattttgtcatagacagcataggatcccagacctcttgacatttctttgccacctagattttatagtcctgctggtacgtgcaagcaccttaaagaagaggctaatactggggaacactaaggtatatatatttattatatcatctctatttttaaagtataggccaatcatatatggatttctctgtaaaatgaaatagtatgagagtatcatagagatcagttggtgttcatttttgaagaatcttgacattgaatttaaatatttacagcctggagcaattaggattctcaaatattgctgatgagaaagtaaattagtgtaaccactttggaaaactgacattagctactaaagctgaacatatacctatacctaccctatgaacagcagtgttactcctaggtgtatactcaagaaaaatatgtgaaatattcagcagaagactgcataagaatctcgatggcagcaagtactctaatctcaaccaatagtagaaaagataaataaattgaatgaaaatgaatagtctctaactacacttaatatggatgaatctcacagacataatattgagaaaatgaagttagatgttaaaaagtatattctttgtgattctgttattcaaaaatagacaaaactaatctcaggatagtggttaccattgggggtttgtattgtgactggaagttggcatgaggaaggattttgggggaatagtgattttctgggttttgatgctggttagaatggtgtgttcagcacatgaaaattcactgggctgtgtacttatgatcagtgctaatatataatactccaataaaatatttaaagatattttaacatattaaatattaaatattaaagatattttaataatataaaatatataaagatatgaattggaatcagtttccagtgtttatcagttaggcttgtttacatgcacctacttgagaatttgccagcctcagagaaaagtagagaatagtctaagtataaacaatatcatttagatgtcatgaaatagccttttttttcccttttgcatagtgtttagtgtgtgatatgaaggtgttgtagccaggtggaataacatcaggatttggtatcattagatcatatttgagttctagctctctccttaaaacactgtgaggtcttgggcccagtcacttaattttctgatttgaaaactgagtatagtaatacctaagactttataggtctatggaattatgtattattttatataatgtttgtttactagaatgcaaatctcatgggggcagtgatttctgtctgtttcattgattgtggtatgccaagttcctggatctgtgtctggcaagtaatcagcacttactatatatttaagtgaataaattactaaaacaaaaatatagaaagaactaaaatagaaaataaagtatctacgtacattttagctgctgctcttttaaactttattaaaagtcactggaaacctgagacttgttgagtttaaaatattatggataaagggtaggattaggccttagagaaaagatattattttttttttcagatatacttgtcaaaatggatgtttctttattcaggtgttccttctaggatgatagaatcctgggtcctagagagaatacttagtgctatactgccatctttttgaaagtattccatacctcacaacagagtagactgttgaaaaagtcacaaaacaactgtacttactgaaaaattagatctttacaccatatatccaaaaaatgtatagctgctggttaaacccatccaaagtccagctttgccttagttcactggtaggagccaagctaggacgggttccagaagaagagttccaaagtccagaggaatggcttgttccagttatgggatcccttatatcgaggctcagctgtgacttatctccctgaaaaggtagcaccaccttcttcagggttgactttttgagcacatgaagtagtagccttaaccacgtggagctgatcttccaagagggcctgatgctttcaaggtcccataaggcatagagataatcaagaacgacactgctgcctgtgagacagtgccgtttctccatggtggtcaggtgccaggtctgtgagcaggagacattcctgaggctgttttccctgtaccagctcaggctctgtatcttctttctgctctcgttgctccttgggctcagacctctgctacttgcctggacttccacttgaatttttccatcgtcttgaattgactcattcagagtgttacccagtcttgttctattgaaccttactctctcagctgcatctcaaatcaaaccatagcatttaccctgccattcattcattcattcattcattcatctaatatatgctaaggtctgtagggataattggcaataaatataagcagttatctgaggctctttgtcctggctgcagtgcctcctgcttaagtcctgcagagcccataacagtctaggtttttctgatgctcttttcacttgccccctagtattctggctaaggcacattaatgatgtacacaaaactgttttctcagtctcttgcattttgggagtgattgaaaaattacatatataaattataaaatatattattatgaaatatattataaaacatatgcaaaaacatacaaaatataatatatcacattttataaatattcacggccgggcgcggtggctcacgcctgtaatcccagcactttgggaggccggggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaaaaaaatattcacaaagtttttggtctctgcacccctttccacttttaaaaatgatagaaaactgcaaagagttttgtttattgtattatatatagcaatatttaccaaattggaaattaaactgataaaatttaaaatatttatttactaattaccttaatataataaacccattatattagtataaataacttatttttaatgaaaaataactgtgttttcccaatgaaaaaatttagtacaaagggtggcatcattttacagttttgcaaaacactttaatgtctggcttaataaaagacagttggattcttatatctgtttccatatttaatttgttgtgctatcacacatcccgtaacctctggaaaacaccactgtacactcttgagatatgaggatgaaaaagttaaatgatgtcttagtatttatatgaaaatggctttgacttgtgggctccctgaaatagtgtcaggaatgcccaggggtccctggaccacatgttagaaatgatgccagaaactcacaattttatttattccttgttacactgcattcgatcaattgaattttagtgagtattcattcaaagaatcttagtagtcctccttctaataagaaaatagtttattaatgttggcatatgtacattttataaataaaattttaatattcattattaatgtaggaaaaaattatagtgccctgttacttagagctttatttggatgaaggatgtattaaatgtaattttaaaaagaaaatgttctacacaggtcaatgacctttataataaacacattttattgcttaaatttagtgcagtaagattaccaagacaaatatttatctttctgtcgaacaatactaataatgctgcaattaattatagaacttatttgaagagagttgcatttatattaaaatacctgcctatatcatgggcacctaaatatatagttgtcttcattatcacattggagagcctaggttcctcatgttttgtaaaataatgattttttcacaggcacacgatcttttagatagcatgcatcaggaagaggtaccagcatgctagtttcttatttaagattccccagccccacgactggtatttatgaaagagaagaaaggatgtcattacttgttcctcaagatgacacagagaggtttatgctgcttgagcagaggcttcagaatgtgaagactcaggcccaggttttgatgtgatttgatggccagtagcaacagagctgccactcttcatggatgattaaagacaaagagagtgagatggcatgaaccacaaagccctgctgccacctgacagatttttcctccgattcaaggaagcccttatgagagcccctttatgtgagcctggttcccttgccagtctatttcaaatttttttaatctctgctactggattgaaagtgtaactgccactttcaatatgcttcagaactgctaatggcaaagttgcttttgggaaccagttgattaatttagacaatgcaaaatatggaggtcccaagtcaagaataagctaaacgactttgccttatttggatataattaaaaggcatggatccaacgtaaatgtgtcacttcccagtgacatctgcactttctgtttgcaaacactgttatataagggctctcagaggtcaagagtgcagaggccacccccttttaaaacttctggtatattataaaaatggagaaatgaaaaagcagtgttaaaaaggaattttattttcagggcttatattggaagaaataatgctttaaacacaaattataatgcaatagaacttgggtattctcaaagtaattacaggatttatttgaacctatctttagtaaagtttgttactcaaactttataaatatacctaatagtagtcatgagtttgaattgtatggtaaataccatgttcttttgatctagtcagaatattccagttatttgagtgaatagcctcatttggagataaatcttaaacttgagtttctttctgggtgtaattctgaaatgatagggtcttctgcttcatcttaaaggagtgacatcacttcatccaaaagcagatactatttaaggtgatggttttaaatctaaggccactggatggccaaatcattgaggatataatattaaaacaaagagagattttaaaattctaaaatgctatatgtgagtatcttataaatgaaatccagaaatatgccaacagttttttcataatatgctcaaccttgagaaaaaccctgtttaatatctaaacatacgtatcaataaataattttacattaagaattactttcctcttgtaaagcgtatatttcaaaaccataattattttaagacctaaaagggattataataacttttcatctaagctttataattgtggttttggaacttaggtaactttttggaactatataagagggactggatgtggtggctcacgcctgtgatcccagcgctttgaggggctgaggtgggagcgattgtttgaggctaggagtttgagaccagcctgggccacagagtgagaccctatctcaaaaaaataaaataaaaaattagccaggcatggtggtgtgtgtctgtagtcccagctactcaggaggctgagggaggacgatcacttgagcccagaaattcaaggttacagtaagctatgatggcaccactacactccagcctgggcgacagagcaagatcatttcttaaaaagaaaaggaaagagaagagaagagaagagaagagaagagaagagaagagaaaacaactatgtaagaaatatctgcttcaagttagaattcagaaaaaattcatgaaactagaaagaaaagtagaagaaatggatatcaattccctcaatgtaagatgaagacacttaggctaaatgactgaattgattcctccatcaagcttcttatagagctagatccagaacccaggatttctgaagtacaacctgttgttctttctagtctatgacttgccaccttcttacaattttacatagtcaggaaatggtatggaactttaaaggctcttccaagaggaaagagaattgtttgtatttaaaaatatatataatatatattatattttatattacacatatatcaatggcaggttttcttttcacaaattgagaaaaaatttagttcatgttcaaatacaacataaaaataataaatataagctattttaaatgcctttatttttatctattttttgatattacagtagtcaggtacaaggaagtttattattacaggcgatatactttcagtgaagagaaaattgtgtgtatgctttattttgtatattgtaggcagggatttttagtgtttcatttaagggagggattgataatccaggtatttttgactgcctctcagatattctttgttaaatgtcatttatttctttaagaatcctgttcagtcaaatatttacttgctttttaacaaataataactcagggcccttcattcctccttttacattattatagagtagaatttcaacaacagtgaacctaattacataagtctttgtttttatcaaagtttttagtgttttgtcagccaaaactctaaaatattacaaccaaatatcagatggatttagttacaagcagttagatttattttttaagtgtgaatgtattacttctgaataaaggaaagagctgatatcggggaaggtaaattcaccgaaacctaaggcagataattcactgtagatggataataatttacttttctatagctttgctattttacagggaggagcgtgtgactctggtttatgtgacttttcagctgtttcttctaagaattccttttttcttctctaaatcttcttaagcttaaatgttcttcccatgtttcttggaagtacttgcaaattttatggaatgcacttctttaaagctgctgctagctaaaagtcctaacccctacattttaccatttcattctattttaattcaggtatttgcccatattaaaaaacataacacattcatttttttttctgggaagcaactgtatccaattctttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaactgtatccaattcttaatacacactctttgacaagtgcaaatgacattttataatcagattgaaaataaatgtttaatacttgctttgtgtgcttttgagggaaaaaccgtttcgatatttgagtaatacattttttgttgattatcacattttgttcttaatagaaagttggtttttcttataaagatgtaatttgattctattaactttgtctttttaaataagttatattttaaaaacttgaaggaaaagcccatttttatgtattgcaatcattttgtatttcaaaatctactttgcatatctttgtatacttgaattaatataaaagcttgataaagagatgagaattaatacactcaacctgtgaggaataaagtagttgtattgttgatttaagcttgttgaatgtgatatctcaggatgctaaagaggcagaccagcaggtttcaggtgattaaagaaagtccctcatcttggaggaacttgaaggaacatgttgctatttaagtggaatctaatcagtaagaagaaaagcttggatgtaaaaagacggaatgtttcatgtcattatttacaaagcaactgaacaaaagcttagcaagataattaagtgccttgatgctaagtagaatttttcaaagcaggttgattagaggtcttcttcaagaaaaaaaaattaaacatctaagtacaaatagtctagttgaaaaggctaactcagttacatagatggagaccagtttgaaagaaaaatcacagtattgtatatggtggctgatgttcacagtgatgcttttaattgctgagcaaaatcccgatcatccctgggtagttatagcactaagagtattttactgtgttttaagtttttgaaaactgaaaatccgtacagacttaatatgcagtggcactgaatgtattattccattatcttggttactccatttttcaattggtctgaataaatagaatttgattctttttcccgttgcctgaaaaaaaaaaaatcaaaagtaaatattatcattctcaatataaaatgttatttgcaactgtcaagcaaaaattggatgtcatgtcttgtatctgcattttgtatttcaagacactcctggtgataacataaggagactggcatgcccaggattgtgctgtgtaaacaaatgctggcaaagccctggcttctcttaagcaggtggtcaggtcaaaacactgatggcagcattatagctaaaaatgaaaactaggaagtcgtgaccttaggacctacttttctaccaaagaaaggaagcttgaagttaacaagtttgtgccaaacacttcagtagacatatgttcttttttcagtgttcttttactgtgttaacattttaatgacctcaagtttacttagtaatgaatactttgggggcaaacatccagtagcagattgcttcatttattaccaatgaatttatttattcagtcagtcattgcagagctttatctctgaagaacacatttgaaaagctaaactgatcctctgctcacctggcagtccactgtgagaatataaaacgagtaactataataccaatctacctgtgggcagtttgcaaaggctgatgtcgtgagtgccatatatgagactctttttgaaatctaaaacaataacccagcccagacattttcagctaaagcatatgatctaaatgcttgaattaaaggaaaaacactttggattatagtccccattagtacttaaaacactcttggttttttcacttgtgctttgcttaagccaatgtgtctcaaccttagctgcatattagaattacctggagaactctaaaaaattctcatgttctagccacactccagaccaatcaaatcagaatctctgattgtagaacttgagcatctatattttgtaaatctctttacctgattccagcgtggagcgaaggttgacaaccactgatttaaccacttgcaatttcttcattcattgtattatttatttttcttggccttttaaaaaacacactgtagcatgacttccttaatttagaatcctgggatagagtttctattttaaaatatcccttttattggaattggactaaggagcattataaaaggccatcatttaggatttatattacttttacattatttaaatatataaaacttagtcactgtggtttgatttctgtggacactttgatggacagagtgcattttaatatgagcattagacatcttttatgctttatttcacattctcccagccgactcttcccatcatccattgctgttgcatcagctgaacagagatataacctgataactcctcaccttagctgtacctgaaactgtttcttcctcggaggtgtgttggctactgctcttgggagtcaggtagtccagtgcatccttatacctgattcagttcttggccaatatgggatgggagcaggtaggagcatgctcttctttctatgtctcaggcagacagttctgaagttattctacacatttcctgatagcatccccagtaagattaaacgtcagttgctcacgttagtcaccagcccaactatacacccttggattggctttcccccttcctgttttacatttacacttcctatcccattcaactctcattctagttttttgggaaccacttctctgaataaactatctgtgcacaagtcctcatctcaagctctgcttttttatttcatacaagctaagacagtatgaaagagaaaaatcatcataggcatgttttagtgcatgctcccttctctattgtgtttttaaaatcacgttatttttctacttaatacattcagtttatcatattatgataagggacactttactcacaaatctcgaatgctggaaaagagccctatccccatgttatctgttaccatgttatccccatgctttcgtctgctgcccttattatcctctgtgagttggttgccttaagatcctcctcctgatgtctcccagcagcgtgacctagattcttgatcagtgtccacaccgaacattcactccaaactgtgcagcaaacattttatagactcaagccacataataggtccataacatcagcataatattaaatggaatgggagagatttttgcagagagaaaaatggtgctaatgcagtgtgatacacttggtgtagtggaaaggcaagcactttacagttagggtcccagtgtagggtaattgtgtcttctgttgcccagaaaataaatacagttaaacatattaataaggaccacccagatatttttttcctccagcattgaaaccaattgccatttctttgttgagcatcagatgtttgaaacatatatatgtgaccattataatgacattgtttgccatgagatactcatataataagaggcacacaggaggaggcacagctcccaaatcacacttactctggggcatacacatcaagtgaaattgtggcaaaaatcctctgcactcttgatcttttctctccgtctgtcactttgtggctgagtgcatgtggttgagtgtgcagaagtactcatggatgatgcaactctcttgtctgagcgtatttccaggctcaggaactaaggacgtgtgactgtagcagatgactctcatgtcttgtgttggatttccttggcctctctctaacttgagaaacagctgcagtggacagttctgtgcaagctcagattcatctcaagctaacagcatttcatctccagcatgagcatgtcttttagcttcctgcccatggccttcttttatgttgctggagttcctaacccacagaccgttaggggccagaataatgaggatgttaatgcctcaaagaccaccatcaatcatcagggtccagaaccttgaataaactccccagcctctcatcatttaggtgggcaaccctgggaggcatctgtacttttctcagcaggtcccaatggattcaagccctagtttcccaaagaagtagcctcagtaatagatctgtatattggcctaatcttcttccctgtgtcattctcctcacaacttcagtctgcttcctgagatcatctcccaaataaacaactgatgtccaggttcttgcctcaggctctgatttcagaggaacactaatgaagagcgatgttaggtcagtaatgtaatctctctgagtcaatacttactcatctatgaaacaggaatattaagatctaccttagaaggttgttgaaaggattagatataatttatataatgcatttatccctatccatggtacatgactcactttaaacactgacaggtgtcttaagagatagacaaatataaatagaaacctaattctaacatgatttctatagagaagacgagaaagagacagagtgaacagacctgaggtgctacatgcatgaatacttgctactggtttccttttatcttcctgaggcagttaccataggcatgatcaatcctcctcagaaccagcctttgcccttgtgttacccggcatgagggtgccctactgttctgctcctccttcccctctctagcaaatgcctccaggaattagggatgcaatttcattttcttagttcactcaccttttaactatgcccattactattccattttattctaaccaatgaattatattctactttcattaagggctttcctatccaggaaactcaagtgggtccaaatttcccacaagcacctcatttacccagcagcgttttgtttagaaattagctcttctatacatagggcatgccgagataactgaagcttatttatttaagttatgcttactttagaaatacaaatattaaaatacaccaattttgtattaagctaaaatatagtaaatgtgggctgtgttttagttagggttgctataataaataccatcgactgggtagcttaaacaacaaacattaatttgtcacgattctggaggctgggtaacccaagatcaaggtgtgggccaattcagtttctggtgagggccctccccctagtttgcagatggccatcttctttttgtattcttgcatggcagagagaaaaagggctattcttcttcttcttataaagacatttcatcatgggggctccaatattatgactaaattacctcccaaaggccccacttccaaataccatcacatatagggcttcaacatttgaaatttggtggggggacacattcagtccacagcattgagtgacaaatctttaaaaattggtgcatctttttagccttcttttatataattcattgagcctaattaaaagtttttaaatttataatttagagttattatacctagcaatccagtgatacctagttgatgagaagttaaactagaaattattgtcagttctgtactagttacttattaaaggcttgttgaataaatcattgaatgatcgaatgaatgatgcatgattcttccctggggtttcttctaactctagaattgtatgattctatgattagcaaatcctttgggaacaaatcttctttcaacaaagttggtctaaggtcctccaggaaggtggaggtgccagtatccttagttgtggactgatgtaattacagctaaggatcatagtttagtttcttttgttggccttgctagagcagcccagttgtggctggggtaagggaacaatagctgagtcccgaagttgacatgctttagccagaatttttacataggcggaacagcgtaattggaaggggatctagcaagtttgtcttggagctgggcatacataaaaacatattgttttttacttagcacatgtgcttcttactggaggtgttaggatttatgaaaattatggagtgctaacatcttcctgatcacactgtgctaccaacataaccccatttccgaagagttaaaattaagccttttagaatcatatgtaaactatgagagtaggttcttactaagggtttctgaggatagcataagaggaatattcaggtgctttagtgcaatgacttgttttagatatagataattatataggtaatctttacagatgtataactatataatatataatgggatatattatatgtattttggctttacttcttcatttataagatatttattgtatatatttgctcaggtaactactgccaataatcaataagtgggacagatatggttttgtgacctcatgaagtgtacagaaaagattaaatatgtaaggtgttcctataccaaagatggaatcattttaaacctaccattgcaaagaaaaatagtttttaaacaaagctgtttttcaaatacaggatcttggtagattaaaagatttatgttgatattacaatattgttaaagaaaatgctgagttttaggtgagatattcaaggtgtgtagctttctatgtaatttccttaacttgaaccaactgttattaagaccttttgaggccaaccatttaaacaccactaggtaacacaaaaaacaatgatatctgtgacattgtatgtatcaaaaattaaatgttataaggacaaccagtgcactaagtaggatacacttgtgatggccttgtttgtgcttattttcttgttttgttttaattctttacattttggagaaaataggagaagattcatgggttggttaccaaaagggaaatgtgaattagtgaagtgagaaacaatatgtatattttcatcttgctaaataaatgtggtctcaagtcttgtgatgaagggcgatgagatactactaagtggctgtgtgtatgtgtgtgtgtgtatgtgtgtgtgtacaatatatctgttagctctaatgatgtgtttgcatattctttgaataaatgactcttttatattcttagaatgttctagataggttgatttaatcagtaacatctttccttaagtttcctaattctagggtgccatgtgaaaagatgcagaagaaaagttatgcttacacagatgacattcaggaatgaatactttctgctataacaataaaaaagtccagtactagtttcaatatcaaaagacgaagagaaatggttatttagaactctgtgcatagaataccaatctggctttctctgtagttaactgattctgaataaagatggtgatttgatcaaatttcaaacattttgaattcctcagaatacccttaattggcacagttttgttctttacaccctttgcttcactcttgctttacaaaagttagtgaataaatgaatgatccatttagtctcccaaagttttgatatactacttttgtcatatctagaatctcacatatattgaggtttattttagaggcttttgttctgtgtcactgtcctgggtccatatatcaactctggattcaaattattttagttactatagcctcataatatttggagaggctgataataccacattactcttctctttcagaaatttccaggattttgacataatatattttttttcagataaacgtagaaattatttcaagtttcaaaatgtattattttcttgtttagtgtattttataatttaatttagagaaactagattttttataatatcaggttttattattcactaacaacacaggttttctcatttctttgtgtctttttaatagcttttatagaactttaaaaattggctgcacacctttatatttgtttctaggtgattactggtgtctattgatattgtgattaaaatgtttgattcattagattttttaccttgatatatagaaatatcattaaatattgcatattcatgttctcataccttagctactttgaattctttttggttatacaattttttcagttaatattttttagttttcttgtgaactattatattgtctgcacttaattagagcttcgtctcattttcacaatttttcaatgaattaattattattgttatattggttagaattgagttgttttatatagcagcatatcactaaataggcattcttagttaagttcagacataaataaaaatgctttgacatttcgtcattaaaaaggtttaatctttttaagttccagggagaaatctttttcagattaagtagatttatttttatttctaggttatgcagaggagaaatgattgttttattaaaatgtataaacagaattattaatacatttatataacacatattaatatacacacattccttcaaatgatttaatttaaagaatttcattagtaaattttataatgttggactatccctgcatttaaaaaaaataaaccctacttgatcatgatacattaatcttttgatgtgttgctatatttttgcatgctgtttttaaaattaattttaaattgagatatagtttacatacaataaaattcacccttttagtatataattccatgaatgttgacaaatgaatacagtggtgttatcaatacccctttaagtgtgttgctttgatttgctaagatttatgattgtagcttctaattctgtaagggaaaaggaccatacttttctattttccaatgttatctgtctttttctggatctggtatcaggcttattttaactttataaaaggaattaagaagatttttatctatgtatatgtttaggaacagtaaataacgggatgatcatctgtttcttaatgattttatagaacctgcttcttcctaggagtaaatctttgaccatcctttcattttctcctcatggtttttccctctggtttttaaatcttcttgagctacttttgattatctctattttcctagaaaatcgttcatttaatttaaattttcagaattactggcaaaaagtttaacaattgtgtaccaatgtatgtttttatttacatttatcttgttctaatgacatctggttaagtgtattttcttctttaccttaataggtcttaaaaattgttttacctatatttttaaaggacagctttacttttataattagctactctttgtcttgctatttagttcttttctggctttgtagtttttctttttttctctgtctggtaatgtcttccacttacactgtatttctgatgtggctggagtgcagtggcgtgcgatctcagctcactgcaacttccgcctcctgggttcaagcacttccctgcctcagcctcccgagtagctgggattacagatggggtttcaccatcttggccagtcttgtcttgaactcatgaccttgtgatacacctgcctcggcctcccaaagtgctgagattacaggtgtgagccaccactcctggccaaggctatatattatctacgttacatgataaacattgtacgacatgagcatgtagcattttataaaaatattcattgacatcatctcacagcttttgatatgtttcttgtcattaatttccaagtaacttataatgctatttttagttgctttacaaaccaataattattagacatttaaaaacatttttgaatgattaaattattttagagaggggatacattcttgtttttatattaattttagtttagtcacattatctcagaaaaaaagtgtcctgtatgactttctgtttctgtatttgaaatcccaatttgaagatctttgtattctaacacatgatgtttaaattgtattatttttgtttgaaaataatgcatttcaggattcatggatttttctcttgttttatgtatatctaatgattaaatcaactttgtattaagtaaatcttataatcactcaattttttatacacttgaatgactaatttctgaaagagttgtgctaaaatcgctattcttttaaaatggtgaatttctccttttttctatctgttattgctttatcagtttttgaagcagtgttagcataacatctcaataagtgagcaatttactatataattatttggttataagttttgtcaaaacatctttcttggtttcattttatgctttttacattgaattctattacatttggtagcaatgttgccatttatacttgctttttgttatccttgtctgttatactattatattttccagttttaacgtttctgtagcatttagttacatatgtagctctagccattctgagagttgctatgttttaataacataatttaaaccatttatatttattataatgactgaaatgtttatacttattcatgacattatattgttggttttctctatactgttttcctctctttggctgtattagacgtggctagccagatgcctgattaagctgaaaatccaggtaaaatctattttaaattcagagagaaaagttctaaccccaaccagctggaaaatggtacatctgtgtgcagttcactaaatgctacatactgctgtatggcatgaattctgcagcactttataaaaatatgccgttctcatatacaaaggtgaacttactgacccttccatctgtgagacatgtgctttgagctgcttttgatatgttggtgaagtgttatattgagccatggcatacatttgtattatagcttcttggggttagaatttaaaactgtggatattagacagttttttctctctctagctctaaaaagaattatatttttaatatttaataatctatatcttttggtaactcttgagctattttgactacattaaggtggtcatacatatgttacccaaactggaatgcttttgatcatgaaaagtgacactgttaataattcatgctggataaacacatatgaactgggaccatctagggcaaaatggaatatagagctgtcctaaccttactagttagaggaaagagatcataggtataacataaatgaaaatttgtactgtcactcatttacccataaaaatacttactaggtaaggtggtaggcagaacattcagcctgggtttagaggtttgtggggcagtaagatttgaattaaagaagagattatgatgctgtggcatggcttaggtaggacacattcaaactcctagcctaccccgtacacttgagtagctgtcagggtgaaactgcaaacagataccttcagaaaagaacatacaaatccagatttatccattttgcatactattttactcatttgtctgttatttacttattgtggtcatgttactatttttcccgtatctgtatattttaataattatcttatattgaatgaccctgcttgcccagtttttctcttttctctactgtaagcaacataaaagaaaatatttcattttatttgtattttctgctcttaactataatattttgcgtatttagatgtgagaaaatgtaatactgtcaggtcatttcttaaagtatggccttgtgtgatcctaaaacattactgagatagtttaagtttcaggtaaatggtggatgattgttacaatcagtattactcaatatattaagtccacattaggtctcaaaatcttaggtctgcatttgattttagagacatacattatggtgtgagtcatttttctataaatcaggtaaaaaatagatacattttgatgttatacgaaactgtatttttctaccatagcagttactaaatatacaaatgatatccttcaagaaagaaatgataaaactgttttaaattcttttatgagtgtattttaattataatctacatataatgttaatagttttcttatttgattagaggaaaattttttgggctaaactttattttattttgaatagtttagtgccattgagcttctttctgtatgtattacaaatttaatacatttaatccattttctccctcattgctttctttcccaaaaggacacaaggctgttaacataattatttggtctggagatgtcagaggcttcgctcaaattattatatatcaactttatttgctctctcttattctgtatagttttctttttgtaaattacgtagtatagctagattggctccctgtaaatatatctcatagcacaagaaatttaaaatatttccagcaatgcctgttttaaaagcgatttcagctgcacctgtgcttaaatctggccacctctagttcagagcaatattcaaacaccaaaagccaatgatgaactggacattactaccccatgtctacaaaggaagaacattaacttaacatagtgtggtgtctagaagaaaatgtacagcctcataaagtttgaggagacgtttttatgcactttaagcttcagtgtaatacctttataagacaggttctgcagagaggggcaatattatcttctcaggctagctagtattacaacacactttcgctgtaatagtcaaacaaacctttattgaaagccaaccatataccaagcagtgttctgggaattctggaaaaatataaaaatatgaaataatttgagatcatgtaattatgtaatgagtgagaatacatttaagtgctacagtacttccaagaagggagagtttagtacttgatcaagaaatttagactgaatgtgaaggtgacaggaaatcattgggcagagaggagaaaagaagatatgctggatagagaggactgcagtggaaggacatggcaaataggaatgcagagggcatgactagacatgcatttgtgttcactagaaattacagttaatggatttggataggaagggtttatttggagttcctcgagaacaaaactaaaaaaatatatacacgatatggttaatagaaggcagtcatgaaggatttttgaatgagaaggttacatgaaactatctgtattttagaaagttaaatatgactatgccatctgtaagctagattggaagaagcagctcaaggatagtagttaacaacatagttgttaagttttaggaacttttgggcatttgatttggtccgctagaagaaaggaacattattgcaaagaggaaatgcatattccttagtgtctctgggtttgtttgtttgtttttctgagacacaatcttgttctgtctcccaggctgaagtgcagtggcgtgattacagctcactgcagccttgacctcctgggctcaagtgatcctcctgcctcagcctcccaagtagctgggaccacaggcgcaggccaccatgactggctaactttttaaaaaagatttttgtagcgacagggccttgccatgtttcccaggctagtctgggtattgtaagttctcactttggagattgattggttttattggtctgcatagggatcatttattagcagtagctacaggaggtccatctcaatgttattaggttacattttctgtactgtaagcaatataaaagaaaatatttcattttatttgtattttctgctcttaactataatattttacatatttagatgtgagaaaatgtaatgctgtcaggtcatttcttaaagtatggccttgtgtgatcctaaaacattactgagatagtttaagtttcaggtaaatggtggatgattgttacaatcagtattactcaatatattaagtctacattaggcctcaaaatcttaggtctgcatttgattttagacacatatattatgctgtgagtcatttttctataaatcaggtaaaatgtaggtacatcttgatgttatacgaaactgtatttttctaccatagcagttactaaatatacaaatgatatccttcaagaaagaaatgataaaacttttaaattcttttatgagtgtgtttttatcttaatctacatatactgttaatagttttcttattcgattagaggaaatttttttgggctaagtttcctataaaaggcagatgtttttaagagtacagattgtgtataataatgaaatgtatctgtgcaagtaacattctgatttgtactttaattgctgtttatatacagtgtgaattaagaataaaacagtgaggtgagggagggaagaaggaatgaggaatataattagcatactcagtagtttggaaatgtaactgttttaattaacagctttgtggtggcaaaacaaacgtgctttgggaaagctaagaataactaggattgtggcatcctccttgggaaaaagttgtttataatcttaatgttttatttccttttggctgacagacaaaagaaaacaaagtatatgaaatatttgtgtcagaagatatttatatgttcagttttaccaattttatgcattattaaaaagatatttacttattaattcaactaaatgccaagcatactacttctactaatattaacctttgtctttgtatccttccagaattgcatttatatatttataagaatatgtatatagagtctatttattcatatttttaaaaaagtgatcacattgaaatcatgttgttttgaaaattgtcttttacttaactagacattaagaatttagaattgtttacttgcatgaatgggtctgattgtcaggtgatttttcagttcaatatttgtccttccctttgtctaaaatggtcttgatttacatttcttagctctaggcatgactagtagatagggctagaaaacaggctttcagagactaagactctcaaacagataaataaatatactaaatgagacatggtaagtgctgttaaagacatgccaatgaagatagtaggagtacaaaggaggagaaactaactttgcctcagggagttgtaaggaactgcaaggaccttctgctgacttttcctctaccctcttcaacctggttcttcacctctgcagtttgttttctctgttttctcctgcctaatactcactcatctgtgatcttttcccttatattttctctcacttaattggcattggtccacttcttttaaatgaaaaaagaagatatttagaaattacaaggcatttatggtttattaaaatatggaaaatgctttttttagaataaaaactaatataacacttcctactcctttgtcataatcaaatagatacgttaaaattgtattaattttttaaaattttccctatctgcaaatatgtggtgtccatcacaatctaagtaagaccatctaaaagtaaaccttaatataacatattttttcatctcttctttaaaataaatacatatgcaatatattatttgttgtggttaagttagaaaatacaaagaagactgggcgcggtggctcacgcctgtaatcccagcactctgggaggccaaggcaggcggatcatgaggtcaggagtttgagaccagcctggccaatatggtgaaaccctgtctctattaaaaatacaaaaattagccgggcatggtagggtgtacctatagacccagatactcgggatgctgaggcaggagaatcgcttgaacccgggaagcggaggttgcagtgagctgagattgcaccactgcactccagcctggatgaaagagcgagactccatctcaaaaaacaaacaaacaaaaactaaataaataagaaaagttatcaaccccaaatttcactgccattatttcaccatacacttttcctgtctttttttccccctctggtataaatatatacatagaaatactaacaacaaacacatttgcataaaaatgggtcaaaccatatgtactgttttatattcagctttgttcactcattcaacaatcaaataaacaactcacaatcaaataaacatctcattagtaattgcacagttgtcttcatttttaatgatagtgttgtaggactctctccttagttcagctaaaagcccgggggtccttgtcacagggccatgaaaaattaggcgtgcagacaatttgaagggtgagcacggtggggtttattggacgaaaaggaaaaaaatacacagtgactctccacaaagccagagttctgctagtgcacttcctgcctggcagactgaacccctgtaccacctaggaagaagaggggccagcctcgtccccgctgcaaacaacgcgaacttctgtggctccatcccagtgtgtactcctcccagtgtgtagcaggtcagttgcagtttttagtttttcccgggaacccccttacacttggctgtctcaataacatagctttctactctgtgactatataaaatttctttaacccctccatatttggttacgtttctaatcactgaccgaattagtaacatctttgtcaagacagctttgcatgtatgtcgagtcgaattttctcttcaggataaattactagacacagaagctctttgtcaaatgttacgcacttttgaaggttcttactacacattgtcgaattgcctcccatgttttgcctacgtatatgctgactagctgttaaaatactgttctgttgaaagacatttatgcatatatgtaatctttatattgtataccggaaccaaattaaataattgaattctatacaaaacatatatattattttgattctttttcacagttaaatggtcccaataacgaggaacattcctatactttacttcagagaggagtttctgtcttcttgtaaatttcccatcaaaatgcaaatacattgcttgaatgggtttaatattagtggatctttttggctttcctatttatgtgtttccacacatacacccacacacatttatatatatatatgtaatttttttattttttagacggagtcgccctctgtggcccaggctggagtgcagtggcacgatctcggctcactgcaagctccgcctcccgggttcacgccattctcctgcctcagcctcccgagtagctgggactacatacaggcgcccgccaccaagcccggctgattttttgtattttttagtagagacggggtttcaccgtgttagccaggatggcctcaatctcctgaccttgtgatcctcccgcctcggcctcccaaagtgctgggattacaggcgtgagccaccgtgcccagcccatatatatgtaattttttaaacatatatatatatatatatatatgctttttctgaaggaatgagcacttatgacttaactaaaatatttttgaggactaatttttttgaatgcatttttttctgtcaattactcataaaatttattattatggcctttttaaaatggagcttttgtctttcttcagtacttttatctacttattctatttaacaataacttaccaaaatattatgtttacttattcacttttattgctatacttacacttttagaagtagcagagtataaagaaatggaatctgaagagccagttttgattccttgatattacacctgctagcttgtgactttagacaagttgctcaacttctttgagattaagtttgcccatctgtaccatggagttaataacacctacctcattgttttgccttaagaatcaaatgaagtatgtttgtacatggggtttgtaatctgtaaaggccttcacaagatgcagcctgttatcatttgaacatttcatatccagaattacttctattgtgtaaattattatgattggaaatttgatgttaagtatcaaaattttaaacatcactacactgaaattttaaaatgaagtgtcatcttttcaaaatgaccgttttatcttacaaatatcatttgcaaataatttctcccttattaacttttattgtagataaaagatatattttattgatgaatattttaaaaagcataaagccattatatttgaggaacaatttttacattcttatttcctttctgaggatgtaagtgatgaattcttgatgaaatagtatcagtattgcttacatacagtggatatattttcattactgtataaataaattactacataaatatttgtttgaaaccaaatacatcttatgtgggaatgaaggcagtttgttgttcttggcttcccatctctgcccaaaaccatttcttaatctcttaatttctaaatacaatagtgtttttgaagaaatatacagggaagagtgctcaaagagtgagttgacttggaagtgtttatttagtcctcaaaaacatgtgcaaaatatcaagaaactttgtcatcttcaaatctggaatcattttagaagatctgctttgaaaattaagcttctaacattaagaaactggcttatccaactatcttgtttcaaggaaaatagaggaggctagttggctgaaatgaaatctggttcattattcactagccttagggataatcacatttaggggaaaggctataattagctcaacttgccttttacctcatgtgtggcaaaatctaattgtttcttctttccttttcctttttttggtaaagtctcctaatattgttctcaacttataaatttcagatttccaaaatattaataaaaaatagagttgtttgcaataattaaacaatatatattgacatgaacatagattcaaaaatttgtatctttaaaatttatactttggtgctgttgattgaacttctcattatactcagttatttattgtactatggctctttgttcaactgtgagtaattaaaaatataatcttacaaagatctccaacataaacaaatctgtgcttctctacctttgtttgccttcttacagcctccagaaaggactgggtttggaagtttattttaattagagtttaagagtaatgaacattaattacagtcaaacatatggacattcccagaagcatttctacaagcactatgttcattggcagactcacgcaaacttcatgatcatattaaaaattcttcctgcttaagaccattttgcttaggcatgtgcaagtttccctcgtattttttctgatatttgtggtttaaaatgtaaaacaaaagttttatcttctttccttttatatatttttatatttgcagtaaccatttttccagaagtatttatctatctttcaggttttttaattgaccttcattatgaacattctaatatttctgctattatttcaggagagttgaataactaggaattgtagttcctacagtctatgatttttaaaaatagagatggtaatatagaatataattttattctcgtaatatgattttttatgccccgtgcataagtatatcttgtttatattttgcattcctaatccttcatattgatttagccaacatttctcttaggaaactaagtatattaattgatttacatgttaattaagtaattttcactaggtgtacttactgtgaaaatgtaaaatttatttgctgtgaagctttcccaatagcctaagtgtatacaagaaatgtagtagggagcagtttgagaatttggaaagcctttaatggaggctgtcagacttccttttgccctgcaatttcacattatatgtgttctccatggtgctatgacatatgccacaaatcttgggctagattcgaagatgaagaattatatcatgtaaatcatcagtttgatagaagagttatactcgaagcacatcttaattatctttatattataattatatgaataagataagatttggatattggctatatttacatagatataaatggggatactatattgatttatacattttggtgagaagaatatgtatttctgttaaagttaccaaaaggtgtctgggtatgtcagggtgaggcattaaccatctagcagggatacaggtacacccaagtagttataaatgtatatattaagtatataagtatgtattaagtacagtaataaaaatatttttaaaaaactgtagaaggtggaggaaaggatgtagggggcaaagcctgggatgcaaaggcttccaggagagagggcacttctgttgtgccctattaaaatgcatggtaagtactgttaaagcgttgaggacaggagtgatgaggaagtggggagttagcttttggtgggagataggagaatgattatcagaagatggtgcatgattgggactttggaggatgggtagaattctgaaagacatcagtggagtaaaggatatccgggtagtcaagtagcaggagcaaagccaaaaatgtgagaacatgctgaacatttctgtaatactcctgtttggctgtgaagtatgtaagagggagataatgctggaaaaataggtagagactggattgaggggagcctaaaatgttaaactgagctgctggactcccatttgtaggaagtttttcagcagcagtgcgtaggatggcttagaaggtagagagattggaagcacagccatgtgctgtgtgtcaggaggcagtaattggattctaacagtgaggggcagatttaataaagccctgaatagggcagacagtgacagaagtaatgggaaggtgggaacagatgcaagaggcattgtggatgaggaattgacaagacttggcaatgcctcacatagggaggcggacaggggaggatttcaggatgagctgaggttttgagcccatgcgatgtggaggagggtggcactggcaactgagatagctatcactgagtaggaacaggactgtgaattgaattaaggtggtgaaaggacatagaggttgacattttcagcagtcactaggaattaagaggctagagtataggagaactcagctactgagtccaccacactgctggatagtgctgccatgataggaaattaatattttcaggaacaaatgattaaagttttgaaaatgtggcaaggccgtcatcatcaatgcaatgcacacaaaaaaactggatgtgactaatcggatgtcagtcaaatcacttaatctttcaacagcttaattttcttagctataaaataggaaaaacagaaccagttttgtatccatctcctaaattccaggattatattaaagctattgctttggtaaaaagtatgtaatatgcagctacatatatatatatatatacacacacacacacacacacacaaatatatatactatatatacacatatatattagtttattatattgagagaactccagaaagaaaaaaaatacagttaatgttttactttctttaattgtacattgtaagatattgcagatacaaaaatttttaaaaagaattaatttttattgggctcttactctgtgataggcacaattctatgtactgttcaaatgttaatttagtcttttaattaacaccaagacattgtattattttcattttacaggtgaggaaaccaaggctcagagaaattaaatgacatttataaagctaggatttgaacgcaggcacacagactccagagccaaggcacctaaacgttagttcatgttgcctcacactgagtaaacatctgctcctgagcaggctttattttgtcattgcatttgtattagtgtggccttccctggtactctcttatttctaaaactcttgcagcccaggtatactgtctttgctttaatgcacattgcatttctttgctctgaaggtaaattggttgagggcttgtctcatgtattatatagaaaattccatggcatagagagagagcacaggctttgcatttagtccaaatgcttgctttaaatggaagcctctgtcttgttgactatgagaccttggggaagtgtcttaccaccctgaatcccggttctcatctgtaaacactgagttatagagagttaaatcacataatatatatatataaagcctacagcatctggctcctaaaagtcaagcaccagggctgacttatcccttcagcacagtaggcacagtgttgagcagtggtccccaaccttctggcacccgggaccggttttgtggaagacaattttttccatggtgtttgggagtgggagatgttttctggatgatcatcaggcattagattctcataaggagcatgcaacctagatccctcacatgtgcagttcacaatagggttagtgctcctatgaaaatctaatgccaccggggatatgacaggaggcggtgctcaggtggtaaggcttactggccattcaccttctgctgtggggctgggttcctaaccagggtactggggttggggacccctggtatagataagccacaatacttttaggaacccaaaaaatgttttagtccaaaacagtattttttttttaatatcagaagggaaaaaacaaactttcaggttaaataaattgttgaatatatgatactattatattcatgttcatgccaatacaattgtaaaatataattttcttatttcttttttaatggaggaaggggcccacagtggcaaaaagtacctcagggccgtgaaagtcataacttagcactggaaatcactccttacttaggttctttaaacctcttctggtgtctaggtcataatgttttcttcatgcattttgttgattcattagccaactaatttctagcttatgtcaattaaaataaaactgacctttgttccctcatacaataagatttttctaacacccccttcctaaatagttaatttccttttctgggttacttctgtaccatatgattaagcatctcgcaccatatataaactatttatttgcacgtctatttctcctccttgacgctcaaagcttcttgagaacatggatcatgtcgtagtgatgcaggacttctgctccttacttcagctaaatctgatttcctgtctcacgaccaggaaaaattaggcatgtggacacattgaagggtgaggagggcagaatttattgagtgaaaggaaagctctcagcaaagagaggggttctgtaaagcaggtctgcccctcacaatgaagtaccagcacatgaaccgaagaggccaggctcctcccttgcatgaggcacaaattcctggtggctgcaccctatcctgaggtactgtttgcacatgcaggcccttagtctgagccacattgatttatttcccttactgcgcatgtgttaagggatggactttttcaccgtgggcatgtttagtcaaaccctctgtgcacaatgacccggtgggtcggaacctctggggactcttccctatctgcctaggtatttggccgtctccttgcctctatcagtagccactgctatgtcctcagtaactggcagaatacatgacatttagaaagtcagtcatgaaagttaggtgaattaaattgattctgtttggaacactgacattttattgccagccataggctaattcgtgtttgtaaatgtgctctgtaactaagatttcacctaaaactttatgtatctgaagtgaaaagttgtcatctatcctgcaatattatctcctctttataagttttctatactgttcagcattcttccctaccagcccaattatttcttaaaaattgaaaagttaaataaattagtttgtcaagacatcttccccttcttgctgaattaatttaattaacaaagggcctgtcaaaatagccaaggcctttgatgtctgcatgtatggattccagtattataaatgattctgtgtccctctgacctaatgggaatacagtgtaagggtaagaaatgagccttaattcctcagtaccaaagagagaccagcattacccaattacatctaggagacaacaaatatcaccactaggatttaagtatctagctttatggatggagcagaacacataataaattattaggaaattggttgctgattagtttgcaccatatagttggtttttttaagagactgtaaagtgttactttgtttttcatttatttttatctctcccattctctgatttataactttctcaggcttgaagagtttttacatcttaatagcttgttatatacagaaaagtgaagcactagagtggggaggaactgtgtgcagtttggacaattgtggatgatggtaccaattacatcacagaagttggaggaaagagtaatttttgttcttactcaagtctggtagtgcacaatagcctgtaacagggctggctactggtagagattatttttcattcttaatatctctgaaaaaaagaagtggctggatttagcagaggaaaatcagtgtatgctcatgtatagagattgaaagttcacaattttggcatggtctaatacttggaatttcatttttattaaataggttcttctaaagttgttcaaattcttaattataaaggaaggatggttggtaagaaaaatgggtaatgattaacttgatgtgaagttttaggggatgattttctcactttagtaataacaatgacagtacctattatagacatgacatttttcaatgttttcacaggcattatttcttttgatgctctaacaggagagttttattgtcatcaatatttcacagatgaggaaattgagctacatggactttaagtgatttagacaagatcttatacttagtctggcagtattaggaccaatctgggtattattcttatttaaaatctcatattattcatgccttccttgcttctaagctctttagttcagtaagatctaatcacaggccggcctcctgctacaattggaaggcaattcaaaacaagctttctctgaccctttccaatctcgcttccctcagattcctcattcaccttcattggccacttggaccttaatcgatgcttttgctccctctgacttgggtgttacatgtggtctgtcccttatttgggtttggtctgaaaacatatttgtcttattttgtcgaattaactactcaattatataccagaacagcaggaagtttagtttctctttcctaaggtttttcctcttctccttaattattcaagaatcctgaagtttgctaaatccaaaggaaccattctgccttctaactgccaagcagagagcaaatttcacttgagccattggctcctactattgcttccaactgtcacacagtgttgctatggtatatttatcttgcacactaccatagctaatatttattcactattgatttttttgctcttgtgggtataggtcccttattatcttacaggcatactccacattgagtgccatgattacaagtctttcaattcacatttccaggtccaatcattatttcccaaactaggatagcattgtggcaggtggctgcgtttagaagggctttctgcataagcctcaggctggaatcatctctcatcctcaaaaacatccgtgtgtctaaacccaagattccagttggtattctccctttccttaaggcattttatttcagtattttattgctctttcctccaacagggatttggaagaggtcatctttatccatcttgataggtctcccaaagtttaaattttagggagcaagaccagagtccttcttccaggaggatcagggaactcagcaaatggcatctttggttgtcttccaaattctttttctcgcttcttcaaggaagaagatcccctcatacttcatattcacatgactaagaagataccttcaaggggccaggaaaataaatgtctttatgtatggaaaggctggtacaattttaaaataaattcccattgggcattctacttaatctctttgaacatgcctacatcacacttatgtttgcataatgctctatacagtttgcacttgtatatttgactcttacaaaatgcagtgaagtagctataacactttaatctcttcaattctaggtagaaagattaaaacctatgaagttagacttgttccagatagctagtaaagggatatattagtttcctggtgctgttgtaacaaagtaccacaaactaggtggcatcaacgacagaaatgtattgtttcaccgctttggaggagtctgaaaccaaggtgttggcaggtttggttccttctgagaactgtgagggagaatctgttccatgctggtccccttgctcctggtagcctgaggagttcctttggctcgtagatggtgttctccctatactgtaacatagtcttccctctatacctgctcaggtgtccaaatgcccctttttataaggacatcagtcatattggattaggacccattctaatgacctcattttaacatgatcattggcaaagacattatttccgaataaggtcccactcgtaggtgctgatggttaggacttcagtgtcttttatgggcaacaaagttcaacccacactataagttaggttttctaaccctaactgtcacaagattttcactatatactggagtctcttgtaatctaaaattttttcaatcactgttaaagcatttgttaggaatacacttaattgttattgatttaatggctcctgattcttttacaggatttttttgttgtttttaaaatttctttttaaagaattctcaactgaatcttgacttattgttttatgataatcaattttctaagagttacttctcaaaatccttgagatacattaaaaaaaatggttaggcttttaaagaaaagccaatagagatgtaacacctgttaggaaatgcagattataattgtaatgtaaatgtaattatacgtgtaaaattttttgtgtctagtaatattacccagggataatagaatgaaaaatttattcactgttgcttggttgctcttgtgtatataaatcccctttcagctcacagggataccctatgtgtaaagaattttaaagttgtaaaatagaatgggcgcttgttactatttataagcatggcatggaataatactgagatgtttcctacatttgaaaaaaatgaatttaactgtcattatcttttctatatccatttaatattcattagtacagtagtttgaaaagtgggctttagagtaagaaaaacaaatgtggctgcatctcaactgtgctgttattgtatgagtgacctttagcaagtagtttaacttccaagttttagggttttttaatgtctaaaattgagataagaagaccattttcctcataggatttttgggaatattgtctaagaaatatatgcagcatgcctataacaattccaggtactttgtgagcagatgatatacatcaacaatattgtcaccaccagttaaattaattagttccattgaaattgtgattactattttaccctattaaattaaaaccctgagcctgaaaagcaggagttgctgggattctgtgcttacagcaatattagaaacatagttggcaataaattattattgttttatgtcagagattggaactatgagtcttatgggcctactgttttcaatacgtttttctgtaccaataataactttaattgttagaacctatccagaaactcctaagattaaaatttttttgtgtgtgtgatttggctattgatttttgcttttcttttttagcaccagatatcctttcttgtttgtcccaaggcttttcattatttgttagagtgacttcatttcatggtattatctacttttattttcaagtgccaatttattaacttaaaaatgcataaaaataaacttttgttgtgtaagtaacacatttgcatgtgggaagaaatggatgagtgcacacacacacaattcaaggcacccatagtcctacaatgcacacaaacacatgtgattcaaggcacagatagtcttacacctcacatagcatcagtgtttgcattttgagataccatatcttaatgtcatcttttgacttttacgccatgttttggtaaactgaatttcgtctggattgaaactctcttctgcatagctaacccctttggtttcaacaatgtgcagagaagagaactcagcagcaagcagagtcaataggggttctaacatctctcttccagccctgggttcctttcatgtaaaggtggcatccaataggactgctgaagtagcatgaattcacaaatggaaattgatttctatcaattctatatgagctagattatcttcataaaatccaaacagtctgattctaaaacacaattggccctaaagatgttgaatgagagttgggaacttgtattagcatagggaggtagccaaggaacagtgttataaggagaagagccccagaaaggcagttatgtctcaactgcactgtgattttatgaactctaattctgttctggactcacactgctcaataacgaggatgcaaagcacctgcagcctcctcctctttattctgtccatttctcaccatgtcttgcagaccaaggcatgtttcctgaattcctagacttaatgctttctgttccattaacgatacttaatacattgccttcttcaaataaaacagatttcctttgttataacgctacatgacggtcaggctagaatgatcctttgctggagccactttatgaatcatacctgtttgtgagattgtaacacaataaattccatgccatcgttttgtctctgaattgagaagaatcccaagaagggcaaatgtcacacttaaatgctatggaaagagaagaaaaggaaggactggagaagaaaacaaaataaaggaggagattcatttttccatagtggatagctacttgaattatttttaattattgtggttaaatctaccaggaaaaggccaggtgtggtggctcacacctgtaatcccagcactttgggaggccgaggtgggtggatcacctgaggtcaggagttcgacatcagcctggccaatatggtgaaacctcgtctctactaaaaatacaaaaaaaattagctgggtatagtggcaggcacctctaatcctagctacttgggaggctgaggcaggagaatcacttgaacctggagcacggaggttgtagtgagctgacattgcgccattgcactccaacctgggcaacaagaatggaactccgtctcaaaaaataaataaataaataaagttaacaggaaaacatttagtaattgtgtattctgtttccccctacaactactgtgagtaatctgcacttttatttctcttttggcccataagttttacattaatcctattttgctatttactgaataaagggaattgagaaaaaggcatttctcattccaagttagccctacaatgccaagtgtaaaaactcaggcctaagtgaagtttgaggtcaggataagccaggctaacagatctttctggattttactttgcatctcattcattcattcatttattcatttaactgatacttattgattactgaggatgtgccaggactgtactgggtgctgcaatagtagtggatgaaacagtaaggtccctattctcatggagtttgactagtgggaggatgaggggagagcgacaagtgtcagtatacagtaaatcagtgaacgagtatttggattatataactttaaacagtgaatggggctgtaggaaaaattgaatgggtaattgggtagagggactggaggataggtaggtaccgttttagatagaatgatcagggaaaatttctctaaggaggtaggattagagctgagaaagagacagatctaagggatgtattccaaaaacagggatagaaaatactactaccctcagataagaataagttaattctgtccaatggcagtgagggggccagtgtgtaaggtacagagaattgaaggacaggggaacttggtgaggtttgggggtttggtggggtctatgtgccacagaaagctgattttgtttttgtcacaatgggaagccattagaggctttgaagcacatgaatcaacatattcttatttataaaggccattctgggaaaaacagtgaaagaaggaaaataaattaagagactttccaagaagtgagagacattggtggtttgagttgtaacattagaaacagagagcgtcataacattagaaacagagagaagttagaggattcaaaatacaaaattgagctgctagtagttgctgttgtattgatgttgggatgaggaaagagatgaatccaggatagtttccggttttgggatctgaacaaatgggaaggttatgctgccacttactgaggaggggaagacttattagcagactagccagtttgatgtgtgtttgggggtactgtggggaagtacttaaaggtcacttctttccccttttgtgtccttagtgctttgtggtgactcaggaagttagagtgtgtacttttttcaggtgatctttcatgagctgcctactctgaacttcattggctttgatttccattgcaacctaatttttgaaataccaaataggagtatcattcttctccctgcaaaaatacttatgtgtatgaagattacacaaatggccagttctcagtaaatcatgtgttcaaagttgtggttccatatagtgatgggtttatgtggaaacagacatcctcatcttgcttcatctgctgtgtaatcattaactcatgaagataacaggactgtctggggtcatgggctgtgggacagaatgaagctccattttctacaatggagagaaaatcccaagaatcagtattttcatacacgaaattaaccagcaaaaatcttcaagaacttaatccctttccagtgaatgagtaataaattttttgttcttcttttttcgtattttgtagtcaaaagctcatgtataccgcagggttttacaacactttctgtctttaaatttaaagcagcaataagcagacatgttctgtaaccagatccaaatgttctggtccctgctttaagttgagaaaatctgatttggcaaacaaataaatgagcaacaagaacagcaaaactaacttgacaaaatgggtcatttagtttggaaaggggtttattgtagaatgcctttaaataataaacaacattaaaagacttaaactataatttcataaacaattttacagagacacatttatttcatctaacattgaccttctgtaatgtgttgaatctaaattcttaagttaaagcataaagtagcatggggatttttacttcattttcaaagaaaacacaatataatctttcatttcattttcctcaatgaataaaatatttgtcactctgtgttataatgtgagcgcttctagtaatttttcatttttacctgaggtttcttttttacccactgctaagttcatttctcaggtcagcaataatgttgggataaattcataaatagttattctttgaatggtgaaaataaaatgtgttttattcatgagtaagtatagtgtttgcttgttgctgatattgtatttgggttgaaatacatattttctttttactattatctattttaaataattctggaaatacagtatgacagattttaatcagtaaagcctagcattgtatgagggtttttttctcttttcaagatagtgtatgtgaaagcatacatcaataataataaaagttgaattcagatgaaaatgctttgaaaatggtcaacatatgcaaatgtaaggtatttttattattgttattgttattctttgtcattattaaggtatactcgataatgatgttagcttggtttataattcaagcattaggtaataaagacaaggtacagttaattctgcattggagactcatattaacaaacgtttttggtaagtctattttagtcatttcatagagggctttgctggaattgtattgcttcaaatacttgttttcagtacttttacattcttggaatacttgcatttagatttttgttaagaggcagtatatggtatggtggttaagaatgtggtctatacctatggtgtcaaactacctgcattcaaatatcacccaagccacttattatctgcaagagcttggacaagtcatatagccattttatacctgtgtttccttatctgtgaaatgacaataataatagcattcagttttgatgatcaaatgtgctagtttcccagatgtgaaacattagaagaatacctggtgtatagtaaaaaataaatgtcagcaatgattatttcttacacaagcctggtgaaaattcaagtttactggttattaaattgcattggttctgtttggggtcttcctcattatgttcagagatcagcaatgccctgaggttttttttttttttttttttggcggggggtcatatttgcctgattatatctcatcgtcaagtagaaacactaaaatacataattcaaaacaaagatttgatcttcaaaagggaaagacaaagcaccatctcaaatttgctgtaccgaagggcctggctcagtgcctgacacatggtaggtgctctgcagacctgggtccacccatggattatctctgcccaggattctgacccataaaaggaagggcattctttccacattcttggtaaatctgtgtaggattcttatcttaaatgtagtctttaaccttaggagactcagaaactttgaaactatagtattatgactgaaatattaagctttttaaaaacacatactttagttcatttagctgtctaatattttctctgttcttaaatttgcaaccttttaaaatgtatggttttaaattacatagtggattattcaggtactcatctaacatttaaaatgtaaacagtgcaaatttttcttaaaggcaagaagcaggggattatcatatgtgaaagggagtagaaatatgatctttttattcttgcttgcctagattttgcagttttaatcaaattggcatttaaaaatactgggctctatctgttaagaactgtctgttgtttatagagatttttaggtgtaaattatctagccagatgtttaagcaccaaagggaaacaagttaaatacaattaacccagtcttcatttatcaagtagttaattctcagcggtaggccacaaaatcagtcttttgatcccaataatatatataggtataactatttagataacataaaatgaaagttacaaagccttattttgaaactctttaagcttggccaaattagggaacattttattcaatataggtggcttcccaaattttggttactgattgcctttgtcattgcctttaggacaactgtagactttgtggatattggaacagatataataattgtactgtaatttcccaccaggtaaatcacataattattatgggagtatgaaaatatctgagaacagggacagggtgggggtgtgtgggatacatacacatatgcatgcagtataaaaataagattgcaaaatgttgcatcatttcagttgctcaactgcagctcaactcaactcttgcatagtcccctataacattgtgttagtgtggaatttaggtacattttaatatgtttcatatgctatgaggtcggacctccctaaaacaatagtcttaggatctataaagttcttaaaactcatctgattatggtgagtttttaaacattttgcataattttttaaattctaaaagtattatgaaatgacagaaggtttgggtttgggaaacaaagggaggaaaaaaatcagctactacttaacaaaaatcatttgtaccttgctctatatctaaatctatatctacatcccattgtactttcaggcttgtactttatttcttctatgcacctacagtgaagttttaaatattctgggctctgtgtataaaggttctgagttcttcagtattcctgagaaggagcttaaaaatactgtgatttttataagtcgcattagagacctaggaaatcattccaaaacattaattttgagccaaatttctaatagggtattaaaaacaggggtatagtggaaattgtattaaataagaatcaggagtttatgttcaagtcgcacttctgacaacatgagttctatcagttgaagtatgtttgcgatacatgaatgtatatgagaaatacacatatacagtcaagagaataagcaatgattcatacgcattccccagaaccatgctttatgcttaaacaagatttatggacttgttttcttgggcttgcatttccctgtgagagagtattttacggtgggctggaaggtgtttctgtttctcttggttaacatatatggggagcaacagaaggtaacaggaatgattgagagggagacaaagagaccttgggaagggtggatgagagcagtggggaggaagaaagaagggtaaggatccaattatttacttgacatctatttgcaactctattaagtatggagataaaaagagagatgggtattaaggggacaaaacacagtggagattttagctacccccagtgttttcctctggctcactgacttccagttatcctctttctttgcttattgttacatgtttttggatatcaaagagagtatcctaaaataactttgatacagttaatgatcttagtggaatgataggagttttaaaaaagaacaaagagcattccatttgtattatagaacaattaaataaaaatccacttacagccataagttgcaaatttttaaacatatatcatttacttatctagctcatttttacctcatctgcctatgtaaacccatcgttattctaagtctcccttaataaactaagatttccttcttactctaatatttgagatctaagtacaatccaaatgtcagaggttattgttgttgttattatttccaccatggagacctccgattttctaataaaatatttttataaattttactcaacacaaattagtttacttttcatgctgtctccaaaagtgaggaagtagagtagttaagagtcataaattcggagcctgagttttggggtttgatgtaactccacacctaactaactgtgtgaccttgagcaaattacttcaaccttctgccctttcatttcttggtctataaaatgatgacaattatagtaattttctcataatgctgttatgaggcttaaattagttaacttggggtaagtgcttaaaacagtacttagaacacatagctcttcatatttcagtggttctccacgttggtgacacattagaatcacctggggagttggtgctcacctcacccattaaatcagaatctttgggggtggggcccagtactgggagcaattgaaattgggagcaattattgaaattgctgaggtgattccagtgagcagccagcgttgggaacgatggccgtaaatggctgtaattatcctgctgactaaattataaacttcctgagggcagggagtccattacttctttttatacatccttcctagtgcagctagcacagtgccttacttgtaactaatgctcattaaatactatcaatgaaagaaaacatgttgatgatattttagatgtgtaaagaccttgcaggaccacagaggtgctaattttaagcattaattattcattccctcatttattcatttatatgtgctacacactttggagtcttgatgctaaacactgcaggcatatatgatttgaaaatgcaatccctgttccaaagagtttataatttagtatgaataaatgcatacatgactttaatagaagggaaactaaccatgtataagtgctgtgttacaatttaggttcccttggaggctgtctctaagatggagcatgcagagcgtttgtttggaagtgctcttgagaataacacctctgcgtgtgctggggaaagggaaagctatggaaccattgaaatatgaaataattggacagggaaagaagttaggttttgatgcattccaagtgaagttttcagctaaccccacaggagctctggggctggggtgactcttcagagtcttaagttgggctgcagggggccaggtttttattcctgcatattgatcagtgcttggatacagctgtcactggaagtagtgaccttggatgaggcatgtttctttagcagaagcaattcccagatacaagtgacagctcagggtgccctctggcagttcttccccggataggggaataagtccttcattcctaaaggaggattcgagtggagtgtcaccgcgtccatcacatgcaacaagagataaacgaacaaaaaaaattatcctggctaaaagaagagagatcacatttatttagatggggaggataagagttagggtgaattgggaattactttttcaaatggatgccattacaatttgatatttaaggatgggtgagatttcaagaggctgaaatgaggtgcaaggtgttcctggtataggaaacaatagaggtaatggtggggaggtatgaagtatagatttgtggagaagcccatgggtctagaagctcaggctaagcagcttaggcataatttggttgactttcaggagcagggaagaatatgtgccagtgtgtattagaaagattagcctggtagcaatatggagacataggtggggcagagcttgcaatcaggaagattaggtaacaagccaatgaaataaactacactaaggatcaatgcaagaagaaaatgcatgagaaaggcaggaaagcagagaactgcaaagagctgagtggatgcaggaggcagtgtagatgtacgtgggacaggtatgacagcagacaaaatgtttctatgtatgtaaggtggtgtgagtggtcagtcaccaggggatagcctagtgaagagaggcacagtgatagagaagagagccagaaagagcagtggctttgatccattatccgcaaaggaagagacaagtgtgaccaaggtttttatagagcattgagtgtgcatgaaggtagattactcatgttgatttgaatcctgttttcttgtattactatctgggactttcttggcaatgtcagaacattctgtcatggccatataaacagcacgtatgtggtctgagcccagtcatgttggagcactgtgctagatggtactaggcaaagctatgaaatgactaatatttgttctaaaaatgctagtcatcagtgttttcactttctagccatcccttccaggcctttagagtactcatccaccttctatcttccttcttccctgtcaaaaatggtcgcttataccacagtgatggtttctccaattatatgtcatctattcctgaagtatctgtagtcataggattcaattcaaattctctttaaatgaattttggtgaataatattattttgagcaagtgggcttctgagcccctggaaatgatgttaagtgtaaggccaccctcggtgatttaattttgagggccagtattttcaggatttgaacaaagtggaaaattaagtgatttttgcggcttcttaaccttggaaggaggtcctggaatgatataaatactgccttctaggggactcagctgtgggacattgtatgacttaatattgttttaatttcttttttctcctctctgtcacaaaaatgagatggatgaactgatcatcccataatttttcattatgaaagaacttttcctacttcatcttaatgtctagggtatttcatttaagaacagcttaaatgagccctctttcaaaataagctgtcctgtaataccattagttcccagctagtcactttgtgaagtcacagaactgtgtacaatctctcttttgattctaaaaccttgggagaaagtaattgaagtatagacacttgagagtctcaattttattgctttgcaaagaaatttcaatttagagtttatctaggttacagtccccaaatatttctcaaggaggataaatcaaatttgttggagagttcctagtcatgtatcattcagtcctattacctgaactgccttgtttgacattgtcagttggaacactctcttggctatgattagaactcaaccttggtttgggtgacaactcactcttcttgcttgtttctctctttctcgcttttaactccgagattcaacatagttctttgaaatgatttatgtttcatcctaagtcattagtgtgtgcttccaagtggccaatctttcctcctttgttggttaatgtttataggaaacctcttggagtaatgactcactgtgatacttcatcacttgcctgcctccttatatttgagactttacccttctttgcatctttaaaacatattctgctctctcagtggtgaatatgattctatgcctgctctatgggtaaacacaaaccattctctatgtattaggaaagataaatgtgtgccactctcctctgtttttctgcaagaaatgttcttttatctgcagactaagaaaccatatacaaaactcatctaggttgcttcacagatgattattcatcattagagtattagaaatcaaatgaaaggataatatgtaactacttttaagaagtagttctccttttaaaataactagctcactcaagtacttctattttttaatgctactttccttactcagtaagagtcaagacactatgagactctgcgaaatttgaattctgcttgttaccgaaaccctgagcccttatagatgatgttagagagcaccttttccaaattccttcaggcgaagcctcgcaatcatgaaagaggggagaggaatgctttggtggttatttgtgcaggtgataatttgtacagaactagacttcagagtcttggagctgaagggagtcacaaaggaaggtttcttcaatctctcttcttttgcggaaagaaggatgtcatcctgactaaagtcataaagcaactagcaacctgagtaattgaatgatttaaccaaagctcactttaatgggtctgcggtccacacctgccctccaatccctatgaatttttttttcatcaatgtatcccaagcagctaaaataatgcctggcacttagaaggccctatttgctcatttactgaatggatgaattgatgagctgagctaagggaaaaaggaattcaaaatagcagttgctttcctcttaggcagtgttttttccaccacctagctataccttatcttgtttgtgtgttttgagaggcagcatagtagaatgctcaaatacagatgttttggaaaagaactgcctatgttcaaatttctgcagtgtaatcttcaacaaattacttacctctcaattttcctgtgttagagataattatagaacaatgtctcttaggattgctgtgaggattacccgagttaacttgggaaaagtacttaaaatgatacctagtatattgttggcactcaatctgtgttagctgctatctcgggaatgggcagtcagtggcatgtggtgtaacgcacagggttcctccctggaggcaagtctggaacttgacaagctcctctgaaacaaggtggaatcatggggtttcagcgtggggtgctgaagacttgcactatgcagctctcctcacatgccacattgagtcccagatttctgcaaccacagaagtttaagagaagctttgctgaaagtttgaaaccagtgtgaatacattcatatggtaaataacagagcctctgaaaaggagacaatgagatgcccaagaaattctatgggctttagtgccacccaaatagaatgtctttattggctcagctgctcattagctgcctgtcctggcaaaactattcaaatccttagaaccttagttttcttacttgtaaatttaattaaaaaatacttcttgtataaaatatgaaataacaggtacatgtaaagtgctaagtgtatcatagagatgtaataaatgataagcccttaaaataacgatcatagccataaaaatccaagggattggaaaaagcaatgcacatactatgtaaagatatcattatttcatttgcttgcttcttcagaaagtaacaaggtggtttctaggcagtcagtgccatgcaagtattttgtctcaggagcctttgttcttgaaatttttatccatgaactctgttaaaattataccatgacttcaaagtcatctctgattccaaagcctccctctaactaggctgcttgcaggagactttggtgtctttcttcagtagaagaagaaagaaagagagaggaagaaaaggaaggaagggagggagtgagggagggaaggaaggaaggaggggggaggaaggaaggaggaaaggagggaaggaaggaagggagggagggaggaagggaagggaggggaggaaggaaggaggaaaggaaggaaggagggaggggaggaaggaaggaggaaaggagggaaggagggagggaaggaaggaaggaaagaagggagggagggaggggaagggagggaaaagaaaaaaaggagtatagagataactaggcataatggacatcaaggccaattttgtcacccatttgtattccctatttttccctttcttttggagcttattgataatgaggtgtttcatctgacttttgtgagtgaaatatggctgttatcaatccatactaccttgtaagatgactggccagcttagtctgcaataacaaacaactgcagaatctcagcgcttaaatcaacaacaaaaggttatttcttgttcgtgctatgattccactattgattagatgggagctctgtgctgcttcatgcttattcagccaatagagcctccactgtctgaaatgttgctagtggccatcatgggtgagggaagatagcaaattatgatctggcttttaacacatatctttgtctaaaagactatgtggccctgacatttgtcactttgagacaggaagtaggctggaagaggaatgtgtcaaatatttggtgaccagaaagttgagtagtcattatttgggattcccgtctattctggttctcttcttctgcatacatggtagggttgcactttgatgcccatttgaattagccattggccagtgaagtgtgcataaggatgatgtgccacttccatgttgaagcttcaaaatctagcgtgcagtttggaatattctttcctcctgtccaagtgacccatatgtttatggctctgtcagtctgggtttttgaatgaagacaaggtggagtagattgctcccaccaacctaagatggatgcgtactatgagcaagaaataatagatttgtgttctgtcattgagatttgaatgttgtttggtctggaacatatcctagcttattctaaccaattctgatagggaacatattaggataaatttccaaaagttaaaaaaaaagttttcttttgtttatctagatatatatctcctcaaatttaatgagcccagaggcaatttttcagtatcatagggagaaaaaaattacgtaggctcctttgattggttcacttgattagtggtaggggtgctggtgttagtaagaggtcatatttgggaacaaggagctgtctatattaattatagctgcaggatgtggttgggctgtcaacttcttttctgctagacagaaaacataatttagggatccatcacaaatacatttatcctaatgacaggatatcggagagcacatgattttcatacacactgtctttcctttctactttttctttaatttaaatgagtttattatatacttagatattttaaagggaagattcttaatttcttagctttgttttatagaaatcaatgaagaaaggagggtattattggcaagtgggaaaacaataggtttgtattccaagcagatggtttgtggacctcaaagatttcacattctctatcagtcctgaaaattagacagagttatgaaatcaagtacagagcgtactactgattcgctgtgtgaccttgggcaaggcacttaatcactttagatcttagtttcctcattttaaaaatgaggataataatactggcataagtcacagggatgttgtgtggataaactaattaatgattgtaaaatgctttgaaagtgcaaagcgttgtataattgttaggtgctattattaagaagtattattactgtgttgtgtgtaattcttattagggcttctctttgctttgaagtcagcctccacgtggactatggggttgggataagtttacagatgtgctgctcaagtgccttttttgcctggagaaaatactcagtagctagggtaatcatcattatgaagaggatctcttcaagataaaaaagataggaaatgatctcctttttaaaaaatggaaattgctctaactttaaaagtatcaatcaattctttaaaacctcatacagccctatgtttcaggaaagtctaacatcatgcaaaatttgaaacttcaggaattttctgctcagcataacatgggaaatgttgttgctaagataactttaaatcagctgaaccagctctttctaattttcccacagtgtttgcttcaaggatgaaaacaagtgaggtatcctctagaggagagaaattctgagctgtggctgtgttttgcatgtacaaaaagttaaaaccccaatccaaattaatttttatttgttttgtagattctccgttgggaagtgtgtttctaggtacataaaaacgagctatttttctgaaggtcaagtatacaccatgtttatacgtgactacctggtgcagctgagcaatattgactttgatgcaaaaagaccacagtcaggccttgggaggatttctcattagctgtgtgagttttaacaaaataatttaacatttgcctcagtttccatatataggaatgtgtgtaaaataattcctgcttacctaataggctctggaagagctcaaagaaggtaaaatctttggaaaatattttacaaatacaatgaaataattaaattgtattacattattttatttaacattttaatcatttttaatgtattcctgagttaacaagcctctacatatatttccattggataataaagatattagaaactcaaataattttcttgcaatgatctacatacatgcctttagttttatatcccatgacatgaagagaaagaagtccatatgcactttctgagaagttgtccgttaagtaggtcaaggggtatctgagatgtgagcgggtagctttggtcatttgcttttctatgattgcacacctttttaaaaaaaaatgctgtgtgcagtcatatatgtgtacagcattaccttttaaaatcaccaggaactaggaacataggatagatttgtttgctatgcaaatgaataaaacttgtaccaaagaaatctaatgtttaactccaagacacaaaagagttgttagagtttgagcttattgtactatcataggggataaaaacttccagaaacttctgagaggccagaagttttcagagtctagctttctaggatctgaggacgaaagtacttaggtctacccttgaggcaccattattttctaccaaacatttcacttcttgtgatcgcctaagtctttgcaagaagaacaaatctcacaatccatttatttactctcctaaaaatgttgaccacgtgaaatgacaatcagtataccacagttgtttatcccctcagtggtgccagagaagaggtaatggcagagtttgtaaggtttgctttctaatttttgtcttactggcatattttctatggtagatgctctggtgggtacccagatccccctttcagaaccgaggcactatttccccacctactggaagtgttgtctgctgatgactcacggctaagtccctctactggacttgactgctggtgcaggaagctgccctctccaaggtaatgcctgcctcccaggggctagctcacatccagtgactcaacaacatagatagtacaaagccacagccccttgttttgatgaggaaactcccaaagactatcttaatgccaaagttctctgtaagtttggctgagacctgtgttacaactgaattacagttttttttgttttttttttctcaaccaaccttgaagccatcaggctgatatctagggtcaattcccaacataacatggacaagaatatactgggtctgctatggaaggaagctcaaagagccatgtgttctccaggaattgggagcatatatgttggactggatccagagggtgctggttcaaagtggttggaacagaaagttgaataagggagagtttatgaacgtgggatcacttgctaatgatagagaatttaacaccctggcaagggctttgggagatggtgttaacatattgctaaaatgattcttgaaagcttggtaaaaatgatgaccaatactataataaatagaaatgccagaattttgctgtagcagacagtggatgaactaatcaaaaggctcagagaagttgtgttggtacacagagggctgaaaaactaacagatggtcgtgttctggaggacctggagccaaacagataataaaaatattagtgagaggagcatcatcatccctgaaaagccagtggtagccatcctctgttgtccaaggttcactgaaaagatgctgttacagaattggactctctgatagcaaagaaaatggtgatgagcataagtctggcccctacaaaaaacatataaattctagtgaatgacagagggctatcacaaactcaaccaggcttcaagtacatggttggcagccattgatctggcaaatccatttcttctcatcttatcagggaggaggaacagaagcacttcacattcacttgaattagataacagtaaaaacttacagtcttgccccagggctatgttgtctgtcttggactcttaaggaacctggactgtctggacatctgctgaatctcacatggatctgttatttgatggcataatgtttatcagacttatctgcagtaagtggcaagtcttggtaaggcatgtgtgatctagaaggcaggaggtagaccttatggggatacaggggtcttctccatcagctttaggtgtctgaggcatgccgggacagcctctccaaagtaaaggagaaactattgcaattaagcagtgagacacgttaagaaggaaacacaacatctgacaagcctctttgggttctggaggtagcatacatatttcacacttagtaatactgttccagtcttttactaagggacattttaatgctgtcaactttgattgggttttagaatagaaaagagctggatagcaagttcatgccacagtgaaatcagccctgccactagagtcatataatctggcatctcttgtgcaaaccccagtaggaaaatgacaaaacagaaccatagggttaggagcaaagacatgccctctgcagctaataattatgcacctttggaaaaataactttagtgtgtgctactgggtgttggtagtatgaagcactgaaatgaaactactacatctgggattgaacacagcaaaggccagaaggcagaagaaaactgcatgagcaggtggcccctttccacatgtgagggaccacagtggaaactgcacttcttcctctgctcacaccaatagctgcatccaaggtgggggatgttatcctagttgataaagaaggaaaaagtatgagcttggttcatgaatttatcagcttattagatgaatgccagccagaaatgtactgctgcagcactactacctcattcaaaggtgcctctgaattatagcaatgagaggaaatcctcccaaaggtcagaggtttgcacattgcaccttttgtatggtccaagttaagaatatacacaaattcatggttaatggtgaatggcttggccggctggtgagggacctaggagagattgaaagattaggctgggtgtggtggctcatgtctgtaatcccagcactttgggaggctgaggtgggtggatcccctgaggtcaggagtttgagaccagcctgaccaacatgaaaccccgtctctactaaaaagacaataattagctaggcatggtggcaggcgcctgtaatcccagctactcgagaggctcaggcaggagaatcacttgaacccaggaggtagaggttgcagtgagtcgagatcgtgccatttaactctagcctgggtgacaagagcgaaactcagtctcaaaaaaaagaagaaaaaaaagaaagattaggaatgagggggtataggaagtggtatatagatggacctattgaatggtcatgaagtgtgaagatctttgtagtatgtatctgttaatgcctgtcagagggcaatcaccaccgaaaaagctctaaaaataaaatagagaaaatgaccgtagtcattggccactccaatgctgacacaatgattgcatgaatggagtagacatggtgaaaaagacagagtccatgaatgggccatatggcatgtattcccactcaacaatattgacctggccactgctgttgccaaatgcctaatctgacagcagcagagaccaacactgagcctccaatatggcaccatctctttgtgagaggagccagctagttgtcaatgaatatcatcagcccccaggtatgactttgcctttcctaacttctgaagctcagctggcatcactgtttgagggctttagagtttctgggttttttttgttgttgttgtttttcagatggagtctcactctatcgcccaggctggagtgcaatggtgcaatctcagctcattgcaacctccaactcttgggttcaagcggttctcctgcctcaacctgctgagtagctgggattacaggcatgcaccatgatgcccggctaatttttttggtatttttagtagacacagggtttcaccttgttgattaggctggtctcaaacttgtgacctcgtgatctgcccgcctcagcctcccaaagtgctgggattacaggcgtgagccactgtacctgaccaagtttctgttctatcaacattgtgtatatattacattgctttagatcaaggggcacactttacagcaagggtagttgtgggggtgggcacattacattggatgctatcacatatcatacttcctagaagctgtcagcctgagaaacccatggcacggccttttgaaggtgaggtagtagtttggcatggcatctgcaaggaaccagcttggagatgatacctgtggggttggggtgccatctttcagatatagtatatagcctaaaataatgactattttacagtgctgtattcccagtactacaatcaataggtccaggaaccaacagaaaaggaacaggagtgtccctgcttaccacctctcctagtcaccctttagggacattttttgctttccacttttagatatttgggctatgtttacctagaattcctggttctaacacagggaatgctgccacaagaaggcgtggtaagatttccatcaaacttgaagttgcagctgctccctgcttacttcaggttcctcatacccagagaccagcaggcaaggaaaacaataatccatactggcaagggtaacgtatcctcaggaggaagtatggccattgtcgcacaatgggagaaaggaaaaaaatatttttggcacccagctgatccacttaggtctcacttagtaccccctattcaaacggacaagtgtgggcagctgtgacctaagacaggtgtggtgattagggactcagtccccttctagacgagggtctgtgttatataccagcaaacaacctggactggaagagatgctagccaaagataagaagaattggcaagggatagtagaggatggagacaatgaatatcagctgtgaccttgagaccacctgtgttgggagctatagtttgtcccactaactttcctcttgtaaatttctacaggagaagagatagactagaatcctcgaggacctgctcccagagagtgagaatttactaacttactatatgaactaggtggatctgagtggcctgaggagtgaactaaaatgcgtgctgtatgtaccacctcgatatcccctacagaaatgagacatccaatccttcagttgctagtagtgttgcctgatgatgattcaaaactaattctctcaatgggaattggcctcttctcaaagtagctgtctcaccaaggccatggttcctccctggcagtaacctgcatctaatgactgggcgatgtaggagcacagaagcccagccctactgccttgatgagcccattgtgaagggtcatctcaggttcagaggtcccattaggatcaactgaggtctctgttgtaagtgccttgtagttcaccttctccttcagttcaatcccgtttctctcactactttacaggcattgttcctgggaatactcctcaataaacttcctgcataacaaatctctgcctcagagcctgtttggaggggaggaaaacttagaactttgtccccaacatcaaaatacaatttaatttaaaaacatttcagtgaagttaatatgttttctgaattagtgcacccaaaaacatttccaagcaccccctttgtgtgttttgattcttacaatctatgtcctttattcattctatttattgaacaattaaagagtgcttctcatatatgaggcagtgtgccaggcattctggattcaatgacaaaaaatgcactcagaaaattcattctggattcaatgacaaaaaatcctgaccttaaggacctgatggacaaaagggaaaagcagataaattaatagacagttaaaatacactataattaatagaacataatgtgggaatgcagacatgggataactaatttagcttgttgagcagagcaacacagagaaaaatttgtaaggtttcccaaaagcactatctgatctgaacctttaagataagtaggaaataggtaggtaaggaatggaatatgttcagagtgggaagcagtgtgaggtaaaaagagaacaggtttggagaaaagaaaacacttctttaggatcagaccaaggagtgtggcagatattagtgtgaggtgcagagagctgttggcatctgtggagtaacttcaggcaggggagtgatatagtcagcttttcattttggatttattactgtagtctagtggatgtagagagaatggattagagaggagaccagttaggagttccttgcatcaatctagctgagaaacgatggctggaaatcatgtagtagcagaggacatgaaaaaaataaaataatggaatcctgagatttgaaggaatttgaactaataaatgtgggtgatggactggatgtggaaatgtagagtggttgaagataccctgtttggattaggaggtagaaatgctattctctgaaatatgtggtgagggtgaaggtaatggtggtaagtgtgtttgtatgtagggagagtattgcaggaaggctgagatatgatgacttttaattttctatttctatttcagacatttggagatgtcctaagacaattggctatgtggatagggagatctggtttagggaccatatcatacagacagtagaagccatggatgatctcattccaggagcacatatacagtgggaagagaatgaagctgaagacaattccagctccaaagatagtgacaagagctgttcatcttcatcatcctctctgtaggcatcttgaattagaagatactatttagtgtggtctcttacccaagataaataatctaagtttccgtaatctttcctcattgttctaattgtgaatttctttggaactttggtgatgttttctatgttcccatttagttctgagtaccagaattagacacattatatttattattatctttgacaaaaatagtgctaaaaaagccttcctaatatgccatatgcatcacggccgtaggaaaataggcgtaccacttgtcacttccctaaaacaggtgctcccaaaggcaattcctgcatgtcctagaggacttttgtgtgtgtgtgtgtgtggtctgtgtgtgtgtatttttaactgccgtttttgaaccaatgtaacatgatagaacatgtattaggatgtaattggttccaggttagttaagtaagaaatgcatttaattctttctcaccccttgaagaatatttctacttctccattaaataaatcagattttaaacaaaaatggaataatccctcaaatgtaattcaaaatacaacacacagtctcttgatttgtgagaattagctattgtacttcttcttttgaaaataaccctttaaacattaaaatcaacagatgacagctttagtaatctgagacaatttcatgaattgcaatatttacttatttgggaggatgttaaatgcttttaaaaattctttgtacctgatgtgaatatataataaatgtgtagagtatttcagttgcatgtaatgattgtgaagctgtaggaaaggtggctttcccaagtcttgagtgactgattccatcttttcttccctgactccttctctccaagtcttctaaaggtataacatctgcacagatgcagggaaggactgcactacaaagatgtgctgtcaatgagctttgcagactggttcttttccctctagccaagccttttttctttttatcctaaagaaccctggtctctttttatttcctggtcaatcttaatttttctaattttcaactcaaaaacactgagatttatctccatttctctgtcttaaagagaaatatacacaaagcagtcagagcattagctaactcagatcctattatgtgctaaggtctatctatctatctatctatctatctatctatctatctatctatccatccccttttaagattcacgacaaccccatgaattggtactattattatcttctcttaaacagaggcaaaggaaagctaagtaacttgtctgagatttcctggctgtaaagtggcaggaccaggcttacagtctccacagtttggcttttgagccaaccctcttaaccatcctgttaccctgcctttcaacagtgtaaaacaacaggagcaattttggtgtgctgcggaatgtaattgggggatctgggtcagaatggagaaaaagcaagagaaatttttcataggcagccaagaataaaagagcctaagagcatctacaccgatttctataacttaggctgtaagagaagtaggaaaagcattttgtttttctgcttaaacttgttgcacagtagaggaagataattttaactaaacttgtttgaggctttaagaagtaggcctcagagactcaaaaatcaaagtgaagtgaagtaaaattagcaattgttttctaaaaattcatgtaactcttagcaatgatttaggctttccaaacaacgtaaattatatatgcagattacttctaattataatgcctttccttctagattattgaacacttacacaataggattttaattgattctcaccagcctgcatctctagtgtttgattaaaaatatgcccattgtcaagaaaataaattcatttaggcatttataagcatttgtagaagataggtgaacaaaatttaaattaaaaaaatatagttatctacatttgaaagagttccttattatttaatcccttttgaaatatgcttagaatatcctttcaaggagatgatctacagatctttatttgaatctaacacttttaaacattttccctgatgtacagattcttgagttttgtttttgtttttgttttacattttgccactcaacaagaacataattcacttacagaattatttttgtgtgtctgtaacagctgtgattttccaccttactaagcagtttggaatttatcagtacatttctatttgtcttattttttaaatttttaatattttttaaaagaatatatggaatcgttaaatgaaatttacaagagttcattgctttggactgagttccagcactaggcccaacagaccagacaaaaccagaatggaatcgctgtgccacataatcaaactgaactttgaaacaagccagtttttcaaaagaggagatttacagcaaccaatcagaaggggcccagtttacctgagctggcatgataaggaagtcgtctctgttttaattccataaggaaagtaactttgaaacaaccacttctcttttgttcacggtttctgctttttcttagcccttttctgcctataaagccatactcctgatcagttcattagaacactcattctgttttctggaatgagatgttgcccgactttagaattcaataaaagcctattggatctttaaatttaagaaaaaccgggccgggcacggtggcttacgcctgtaatcccagcactttgggaggccgaggtgggcagatcacaaggtcaggagattgagaccatcctggctaacaccgtgaaaccccgtctctactaaaaatgaaaataaaaaaattagccaggcatggtggcgggcgcctgtagtcccagctactcaggaggctgaggcaggagaatggcgtgaacccaggagcggaggttgcagtgagccgagattgcgccactacactccagcctgggcgacagagcgagactccatctcaaaaaagaaaaagaaaaagaaaaaccaattatatctttaaatttgttgtaattttgtcttttgacaggatctttatgaagttacatgccattgacaatctttgctgtgttgttgtaacttcaggtatgctactgcaatgagcatgccagttggactcttagacaatggccatctgagtaagaaaaaatttcagttgttttaaaaaataagtgtggtattcattttgtaatttattaaaataacatttgaattttcaaactagctattccctgagattcagaagtctttttgcctgctttttttttttaagatgaagtaatctggctataaggaatattgattatattagtctaaggacacttacagagaaagtaagcttactgtagtgtgaatgatgcttctctttctattaagggtggtcattctaaatatgactgcataaggaataattctggcaaaaatcagtccttcattttctcttaagatatttagaatttaatttaaatattatatgtcaaggttaaaagttagaaacatgtaaggaaatatttaagaacttacaatatgaaaacctgttttctttatggaactctttggttatatgattggataggtaaaaacaaatttgtaaaatatggtagatatgggaaattgtcaatatatttgtaattcatgcagcaaacataatatttaggaagtatgttattctgttttcttaagtacataatgataagggttcttttctccaccaagccccttttctacatttgtggttttcatttttgctgtttttatgttattattgatagtatctcaataccaacctgctattgttaatttgtgacattccttatttagtctggaaagtggaaggtagtagatagttaaaagtttttggtgtctgatacagagatgtttatttaaaagtatagtaaacaaaattaaataaattgagatgtttttgaaacatggcttctctaactccgaagaactttgtgacaaaaaatgatctcttatgataatattttaatgtaaaatacaagaaattctttgaattaaaaaacattgtcttgattatcaccatttaggcatatattgaaagttctcatttaagtggtagaaattatttgaaatagtgttagtttcctgtggctgctgtaacaaaccaccacaaacctggtgatgtgaaacaactgaaattttttctctcactgttctggaggtcagaagtctgaaatcagtgtcgcggtgtggaagtccagatgtgggggagctctgctgcgttcccgcagaggccctggagaggaacctttctctttcctcttcctgccagtagtggccactcgccttctttggcctgtggttgcatcactccagtctctgcctctgtggtcacgttgccttccccttatttgtctgggttgaatttccccatgtgtcttttttataaagacatttgtgattcattttaagcccatctggataatctagaataatttccccatctcagaattcttaatctcatttgctaagaccctttttccacagacggtaacatttacaggttgcaggggtatctttgggggccatcattcagcctactctggtaatctttattcatatttaatcttcttcaaaggaaattgaagccaatgagaaaagcagtttcactcaactactctgagttggtgataaataaaaaatccctatttctccaactggtgttgcatgtaaagttacctgctatatattgccacctggatgggctgccttcgcatgaactaaattcaaataaacttaaaaaaaccaaattcatcatcttttttcctgaggtagcaactcctcttggctccgaattctccttttagagtcaccatcatcccagttatcgaggcttcccttggcagtcatctctgactctcgcttccttctctcccacatcctgtccttaaacgacctccctcttgagttttcacatacttaaaacatcaccagacacataagtccattgaaaccacctcaggcctttttaatttaaagactggggtatcatcatagcctcctaactggccacctcatgttagtattcccctatggcattctctcttatagccactgggttaatattcctgaaacactaccatggccatctaattttcctgcatagacatattgtttggctccttatttcatctgaagttaaatataaactcagcctggccttgatttattttgtagcgttatttctgatgctctcctcacctgacactttgggtccaggagcattgctctcttcacagccccctgggcgtgccatttcccacaacccgccacacccccacttctgacatgccttttcccaccttgcctttcaaaagtctactcacctttcaagatccatctgagatgtggcctgaagtaggacatttccctctctcatttctaagtaatgtctgccacattaccagcttgagttacacttttccataagcttgtcatccctttggaggatggacactgaatgagcaaagatgatgccttgtccattgttaaatttcttcagtgttttgcacagagtaagcatttaataagcatttctcaaatgaattttgtaaaggccaccactggaagtaatttgctgttttcacatcgatttgtatattcctcctttccatgtgcttctttgatcacatattattcataaaccttgtgactgtttttcatgcctaacatttggtcacaattttggctttttccttcttatccctccccccgcccaactggagtttaatttattttcctatatggtcctgtcagcagaactgttcagagaatttgggcaaatcaggacttcctgagagagttttacttgaattgcctgtaagtctgtaaatgttgtggggcatagaatgataggaaagacctctggttttcaatgctgaaggctttttattgttaagatatccaaaataggcatagcatgtttaaaagtaaaaaccctggacctgctctctctctttcatctgaaattatgtgtttgccagagtataatagctctagacaggaagttatgccctcagggcataattcttgcaagggagagaataaaaagtttagactcatgtcacatcctgaatctcaatcccttcatgtctgggcaatctgcagggagaacttttgttctagtcttctttgccagagagaactctggggttagcattttagtccacagtcccctgatgaatatttattgagtgcagagtgcaatgaggatatggaggtgaaggtggtgtggcctgtgtcttcaaggagcggtgtccctatagttgtcagaaagaaactccaggaaaatcctaaagagggagtttaaaattgcagatatcacagttatacaatcagtgttgaattatttccgttttcctcatgatcagaggcccctggagaggcactctggcattgtcctagtattactatcctgtggctatttcaattattgcttgacttcttcccaatgctttcactcatcttgtcatggtttgggctagaggttccttcactacacccactagcaaaggtgacaaagccagatttgtacctagaaaagtcactaaaatgctccattttccaactttccaaaaagcagcaatactgatcatactcataagtaaataaagctcattgatattgaattatctctacccaaaaagaatgtccatcacaatagtgttcataaatgagaggcccttctttgcaatacaaaggtaaaaaatgcaacataaaattgtatattgtgctggcaattaatttttacttattaatacattataacagttactttctgcctgatgtatttgtcatttacaaagacacaagaccttatttccatatttcagtcagtgctttattttgatcaatactgtattcatgtatgtaactctcatatcatactcttgagttatgttgaagttttaaacaactattagacaaataatgaatgttacatgttgggtacaagcatcctttgaaaaatcaagaagataaaagcaaagccaagagtatatgattcattttaatgtaatactgggataaaaatgtgaggatgtgatgtcaaatggtaataaatgctgagttttcccaatgatatgagacaaatttgacagaatacaaaattttaggaacatgtttataaactaaattagtctaatgttcaatgggaaaagtggaatttgatttatttatgttttgctttactgcatttattaatttttaaataccacacaatttattttcaaggtttatttatcttcatgtttacttgatgtaattctattgctcattatattgcacagagcttgtcacctataagaataagagttctatgaaaatggatcattttaatgtgataatgaatggaataggagtttagcttcatttcatttttcatgatagaatttgtttcggaagttcctatcctccatatcaatgtcacgcccaaatatttctggcttaataggaacttctgaaacaaattctatcgagaaaaatgaaatgaagttaaattcctattccactctctgacccccgtctctcctctgtcttcctcctggcctcttgcctccccgcccttctccctccttccctctcttctttctttcaccggagggcactacagcatttaagcttacacccctgattgaggaccgtccctttcttagggactccagaagaaacacctgcaatgttgagacacgaaaggcaagagtgatcctggaaagccaaatgggtgcctgtagaagaggaaatgatgcacagggattttgctttgattcatcaccaggttgactaggtgaccaggcttcttaccattcatgtgatctgcacctgtgatcaaaagccttctttatattctgtgagaataaaagaggatggccacaaaatattctataatcttctcagtgtattgtacttcatatctacaacaatattttgagcacctactaatataagggactgtgccttgtatccaagatagaaaaaataaaatagctcctgctctatttggggaagaaggtcaaaatcagggtaagggaatccagaggaagcaaaaactgatactgacggagtctgtttaagtaaaggcactgaattgtggaaaggtaaaacacatatgaagactggaattcaaataagaaggtctcccaaaagctgaaatgcagaataatgatggtagataaaaataatctctgacctgagatggtttttcatactctacaaacaagatgggatttgttaatagaatacacctactgaaaaatgagactggagggagctggtgggaggaaggaatggcctgagagaacaggtgggggaagaatagagattcagaaagattccatcaaacacttttgcagctgccgttctatactggtttgaagtcctagtttgccttgatttacatgtgtctaacagttgactctactggtatatgtgtctccagctttaagaagaagaaaaaatccactctaatgacggatattagttgccacttaaagatgctcttcagatactagtgttccagttaaccattaaagatatataacccctgtacaagttggcaaccataccaggtcattgatttattatcattaaactgcctaactagtagttatgttgagatgaatgctgggtaaaatattacaatgaatgctaaatgaaaaatacatctcaggcttgtaagctcccaccttgtgtagtatttctgtgttccctgacaccctgaagcctaatcgtgccttctgtatagttttacatgtgtagactctcttcttcgttacgatttgccaatcccctgttgctcacattgtactacagcaataatctttgtcatttttgaattggtgtccaggtggttgctgtcacattacatccatttttaaatgttgctcaaacccactgaggtgacatgcagttttccaacagtgtgaattttttttttccaaattttttctcttcgatggaagaaaaatttgctgtcttctttgacagctggacaagtagagattgcaatctcctttccctctcagtattctctggcaacatcatgaataagcaacattttagatggttgacttccaaaaaatgtttcttgtcaagctcctgtcaggattttggaagtcagggaacaacttttttccagttgtgattttctataatttcatttctgaagtctgaattatgatttttttttctttctgggtttttttttctgtagtaaaaggcaggatgggaagaaaaagtagctcagttcctttttgtgttgatgtagagggtggtacatcattggaaatctataatgggattttctaaactggtagtttaattattgttatattttaagttgaattatctctatcatgagccaatgtctaaataaccttacagtaatcatttttatggtatcagatgattttttaaaatattattacatttcatacttacaaaagatactgggaaatacattagacatttcagaatttctctcagttatgactatgagaatgaaaagaaagtcttttaaacagtcctgggattttttttttctgctgctatctagtctacttcaagttgtaattttcagtggttcttgttggtaaccccaatttaggccactctagagataggcctcgacaggattatatatagagagagagctcagcttagtcgttgagagcatggactcagaagatgggccagccctaaacctgattctgccaggattcatgtgaccttgaataaatttcttaccctctcatttgctcagtttcctcatctgtataatgaggataataaaaatcatatttactccatgaggttgttgtaagaattaactgagtgaggctgggtgtggtggctcacacctgtaatcccaacactttgtgaggccatggcgggaggatcacgagatcaggagatcgagaccatcctggctaacatggtgaaatcccatctttactaaaaatacaaaaagttagccaggggtggtggcatgtgcctgtagtcctagctactcgggaggctgaggcaggagaatcacttgaacccaagaggtggaggttgcagtgagccaagatcgtgccacagcaccccagcctgggcgacagagcaagactatgtctcaaaaaaaaaaaaaaaagaaagaattaaatgagtgaatatgtgttaatctcttaggttagtagcacatagtaggcattgtgatggtaaaataatacatacatacctaatttatatccagcctcacattttggtactgggaaactggatatcttgttcaacagtggtattcatagtttaatctcggcagcaacaaagtgccctggggttcctgactgaggtagaagaatttataagtgtaagctgtttccattttagtgtagtctaaggtaaccctctcctttctttttttcctgttatgagtaagcttaattttttttaatatatagagtttacctttaaagaagttaacacatcattaagatctaggtaccttcttcaactctccccattcactcattccatttcaatttcatgtactccaatcaactttggtatgttttgaaatgttattattatttatccaactttagaaggttctggtagagttagttcctgaggctagggaaattcttttaattaataatctttctgttaatcaccccataatctccatcagctctccaatccaccctgtctgtggccagacaggactgtggtttagttcaattgccgtcaggatacacatacgcaattcagtgagaattttgccaccatttttcctctttcagaagttgattacagaatagccatcattcaatgaaagtctacaggcttctctaattctcttgcagttcacagtcctttagccaacagcaactctacaccatcaaaagtaggatttactgaggtatcacttaaattcccccttgatttaagttcttaagtttcaggaccacttaagtattatgaatgacaaatcaacactcacatagtattgcagaagtatagcttgagtaagtctaatggggaacactttttttacaagctcagggtaggggatattttttgtcactccctcaagcaagcgaactacaccagtagaattataaatcgttctcaactctccctccctttctttttgttccacctccagaccatagtaggggtttaaaatttttggtgttgttgtttacttttttggtacttcggggttacctgtggacccctttccagaatattttacaggcatacgataaagtgcaaaaacttacttaggaaatcagttttatggaaatatactgatcacgattttgaaaaatgtgaagactaatttatgtgcttttattttaacacattaaataacaacagctaacaacaggtcaaaaaatcactgcaattcccaagtactgatgggtataagtgaaatattgagatttctatagcaactggaatctaataggaaaataactgtgatttctgctgttgacatagtcacaagttttcctgaaactactttgcttttttccctcattcacaagtgaaggaaatgggaagattcactcagagattagtgaaaaggatatttttttttctaagttcatgaaccctaagtccctgaggatgcagacatatatacatctagttttctatccctgaggagctttatagtctactgggagagacaggtggcaaggtcaaagagtgctgagaagtggggccactatcaccccataatcttcatcagcccttcaatctaccccaaattatctaatacaggcacacttcagagatagtgtgggtttggttccagaccactgaaataaagtaaacagcaataaagtaagttatgcaatttttttggtttcccagcgcatatggaatttatgtttatattctactatagtctattaggtgtataatagcattatgtctagaaatacaatgtaaataccttaatttaaaaatattacttaaaaaatgctagcaatcatctgagccttcaacaagttgtaatctttgcaggtggaggctcttgcctcagtgttgatggctgctgaatgatcagggtggtggttgctgaatgctgggatggatgtggcaatttcttaaaataagaaaacaagtttgacacatggattgactcttccttttatgaaagatttatctgtagcatgcaatgttgtttcatagcattttactcacagtagaacttctttcaaaatttgtatcagtcctctcaaaccctgccactgctttgtcaactaagtttatgtaatattctaaatccttttttgtcatttcaacattgttcatagcatcttcaccaggtatagtttccatctcaagaaactattttctttactcatccataagaagcaactcttcattggctcaagttttatcacaagattgcagtgattcagtcacgtatttaggctccacatcttcaggctccagttatcttgctgtttccaccacatctgcagacttcctccactgaagtgtttgaagctgtcaaagtcatctgtaagggctgaaatcaacttattccaaacttatgttcctgttgatgtttgaattttcttccatgaatcacaaatgttcctaatgatatttagaatggtaaatcctttccagaaggttttcagtgtcctttgcccagatccattggagtaatcactatctatgtcagctatgggcttacaaaatgtattttttaaataataagacttgaaagtcaaaattgctccttgattgatgggctacagaatggatgttatgttagcatgcaagaaaacaacattaacgtctttgtacatcttcatcagagctcttgggtgactgaatgcattgtaaatgagcagtaatgttttgaaaaaaatctttttttctgagcagtaggtctcaacaatgggcttaaaatattcattaaaccatgctgtaagcagatatgctgtcatccagactttgttgctccatttataaagcacagttagagtagatttaacatagttcttaaggaaccaaggatttttggaatgctcagtgggcactggcttcaatttaaaatcatcagctgcattagcccataacaagagagtcagcctgttctctgaagccttgaagccaggcattgacttcttccctctacctatgaaagtcctagatggtatcttcttccaatagaaggctgttttgtctagattgaaaatctgttagttagcgtagacacttttattaattgttttagctagatcttctggataacttgctgcatcagcactcgctgcttcactttttacttttgtgttatggagacagcttctttccttaatcctcatgaaccaacctctgctagcttccaacttttctcttccagcttcctcaccattctcagacttcatagaatagaagagagttagggtcttgctctggattaggctttggcttaaatgaatgttgtggcaggtttgatcttctatccagaccactcacactttctccgtatcagcagtaaagggctgtttcagtttcttatcattcgtgtgttcactggagtagcacttataatttccttcaggaacttttccttcgcattcacatcatgggtaactatttggtgcaagaggcctagcttttggcctctctcagcttttgatgtgcctttctcactaggcttaattatttctaacttttcatgtaaagtgagagatatgcaactcctcctttcacttgaacaactagaggccattatatagttattaagtggcctaatttcaatattgttgtgtctcagccaatcgaaaagcccaaggagaggaagagagatgggcaattgctggttggtggagcagtgagaacacacaatatttatcaattatgttctcctttttttatgggctttattggtggtgcccaaaacaattgcaatagtaacatcaaagatcactgatcagagatcactataacagatacaataataatgataaagttagaaatattgcaaaaattaccaaaattgtgacacagagacacaaagtaagcatatactgttggaaaaagtggtgctgatagtcttgctcaacacatggttgccacaaaccttcagtttgtaaaaaaaatgcagtatccgtggagcacagtaaagtaagctatgcctgtatttaaaaaaataaaataaaaaatagaataaaatcttaggttgaatattaataaaataatgtttagaaaacattagtatttttactgttgcataacaaaatatccaaataaaacttacatgttttatatgtgaatgccactttacataattcccttagctctgctttcaaagtactgttgctgcccaatgtcatatccccctccatccatttttctatatggaaattctggagcccccactgggttttaaaacaaaaaataggttaaaagttaattgcagtctcttaacattattattatgtcagtgcaatgctgagaacttgttggttgagtgatggtggcagctgttacacagtggtcatatggcagattgtaaccctgaggcctatccacaattcaaagctcatgtcattgccagctagtgtgataactcatacctggcatttttgtttactagtgcaaatggcactgacattttgtgaaaacattgtaaaaagtttgattcatttggtctatttgaaattaagacaggcttgatgagctctaggagcattcacaaatttaaatttataaatagagatgttaaagtattttatattactttgtgtcataccattcataatgtactcttccttaaaagaaagaggaaaagaaaggagatattaagttaagtgtgttaataggttataccagtgtttgcatgttagatagtcatgtggtttagcttgttacttggcatatgtggccccgattgtcacatgacaaggcacctgtggtgactgtcctttgttcacagctgcagcctcagctcatgccacagtacctgaaacctggtattttataaagatttgttgaatgaatgtatgggtaggtaaatgaatggatagttggatgcctgggtgtgtggatggatagaattttttttaaaaaacccaaaacttccttaagctgtagttagtcatctataacatggaaataataatacgtaactgataagattattatgtgaattaaaaacaataatgtatataaagtacttagcttgcatataagtgggaaataaattgtagcattaataaaaatatataattctggttctattaaataactaaatattttttgccaataattaaaactgactgcttttgtgagtctaagaaacagcagtgaacttggattacagttttatattctttgcgtctagaaagtgatgtttcatcacaaggcaagggctttcttctcatgacaaagagcctgatgtagctgcttaataactgttagtaacactgaaaggatctacagtaaatctgttagaaagctgtgatcaaaaatgtgagtgccaatcttcaaaagcccatttcaaagcttgtttgctataatactatgtagtggtttatttgcctttctttgtaactcattaaattaaaaatttggatccatcctcatggggttttcagaaatggttttataatttagcattccaatgacacttcttatttgcagattattatatactagtttttttgtcccactgtctcaccccagtgtagattattaagtccatatcattgcaatttgccaaaactctctggataaatgtctatgagagccaaggctccattttacttgtttatcgaatatggaattaatgaactatcttgaaacaatgtttataactaatgtttatatgacagaaaattggtgctgatcgtagtgtacatatgcaaactaatgctattttgttccccttgcctgaactctggctacacaggcagaattatattgctgttgtgttcaaacttcaaatacaatagtaactccagatgccatttttgtgttcttgtgaacttggagtgggtaaccaaaagcaaacaacaaaaacaaacaaaattgggacaggtgagaggcagtggcatggaagggagtgtaggcaggaaacaaataatatgatgactacaggatactacattctgatgaagactttacacttatggattgaacaactgttagaaaaagatcaaacatattatttgcacaggggtaatgattattttagaattacttcctgtcagtgataaatagctttatttaagcaaaatccaacctcttgaaattgttctccccttcagtgttatttttgtcattattttttcttcacttaaattacatataactgtaaagctctttgaaaaagtatattatctaaatgcatctatttaaattgaatgggtattaaatttattaaacatatttacaaaatataagtaagacatgaatttaatatgagtctgttgaatttttcattgtagttgaatgaatgaataatatattctagtcagccttttcattttctggtgcttctttttagcacccatagactttcatatattgtaaacattttcttctctatatctagttttagaaaataaaatgttgggaacacagaattgacttctggagactgggaagtatataactaaagtaatatgtgtttgctttttctaatttaattttgattgtggtgtgcttaatttataatcttttaaaatgttttaattttactcaaatagatctgtacatactttttatactcaattaacataattatttagctatcatacttccgtgtgtaagatttctagagcatcgccataatgtagcactttggtttgcaggagagaaattttcatggtacattatttacttgcattcaagtgaaaatattgttaatattggttgcatttgaaggattctttcaaaagtacgtggtgctcaagatggatttaaatggaacatgcaagagacagtaataacagagagatcacattctctctgtaatttattttaatgccattacacagggaattcaaggcagataaaaaactccatttacagaaaccaa

SEQ ID NO: 1197 - DNA, 268473 bp, Homo sapiens
gttaatgtttataggaaacctcttggagtaatgactcactgtgatacttcatcacttgcctgcctccttatatttgagactttacccttctttgcatctttaaaacatattctgctctctcagtggtgaatatgattctatgcctgctctatgggtaaacacaaaccattctctatgtattaggaaagataaatgtgtgccactctcctctgtttttctgcaagaaatgttcttttatctgcagactaagaaaccatatacaaaactcatctaggttgcttcacagatgattattcatcattagagtattagaaatcaaatgaaaggataatatgtaactacttttaagaagtagttctccttttaaaataactagctcactcaagtacttctattttttaatgctactttccttactcagtaagagtcaagacactatgagactctgcgaaatttgaattctgcttgttaccgaaaccctgagcccttatagatgatgttagagagcaccttttccaaattccttcaggcgaagcctcgcaatcatgaaagaggggagaggaatgctttggtggttatttgtgcaggtgataatttgtacagaactagacttcagagtcttggagctgaagggagtcacaaaggaaggtttcttcaatctctcttcttttgcggaaagaaggatgtcatcctgactaaagtcataaagcaactagcaacctgagtaattgaatgatttaaccaaagctcactttaatgggtctgcggtccacacctgccctccaatccctatgaatttttttttcatcaatgtatcccaagcagctaaaataatgcctggcacttagaaggccctatttgctcatttactgaatggatgaattgatgagctgagctaagggaaaaaggaattcaaaatagcagttgctttcctcttaggcagtgttttttccaccacctagctataccttatcttgtttgtgtgttttgagaggcagcatagtagaatgctcaaatacagatgttttggaaaagaactgcctatgttcaaatttctgcagtgtaatcttcaacaaattacttacctctcaattttcctgtgttagagataattatagaacaatgtctcttaggattgctgtgaggattacccgagttaacttgggaaaagtacttaaaatgatacctagtatattgttggcactcaatctgtgttagctgctatctcgggaatgggcagtcagtggcatgtggtgtaacgcacagggttcctccctggaggcaagtctggaacttgacaagctcctctgaaacaaggtggaatcatggggtttcagcgtggggtgctgaagacttgcactatgcagctctcctcacatgccacattgagtcccagatttctgcaaccacagaagtttaagagaagctttgctgaaagtttgaaaccagtgtgaatacattcatatggtaaataacagagcctctgaaaaggagacaatgagatgcccaagaaattctatgggctttagtgccacccaaatagaatgtctttattggctcagctgctcattagctgcctgtcctggcaaaactattcaaatccttagaaccttagttttcttacttgtaaatttaattaaaaaatacttcttgtataaaatatgaaataacaggtacatgtaaagtgctaagtgtatcatagagatgtaataaatgataagcccttaaaataacgatcatagccataaaaatccaagggattggaaaaagcaatgcacatactatgtaaagatatcattatttcatttgcttgcttcttcagaaagtaacaaggtggtttctaggcagtcagtgccatgcaagtattttgtctcaggagcctttgttcttgaaatttttatccatgaactctgttaaaattataccatgacttcaaagtcatctctgattccaaagcctccctctaactaggctgcttgcaggagactttggtgtctttcttcagtagaagaagaaagaaagagagaggaagaaaaggaaggaagggagggagtgagggagggaaggaaggaaggaggggggaggaaggaaggaggaaaggagggaaggaaggaagggagggagggaggaagggaagggaggggaggaaggaaggaggaaaggaaggaaggagggaggggaggaaggaaggaggaaaggagggaaggagggagggaaggaaggaaggaaagaagggagggagggaggggaagggagggaaaagaaaaaaaggagtatagagataactaggcataatggacatcaaggccaattttgtcacccatttgtattccctatttttccctttcttttggagcttattgataatgaggtgtttcatctgacttttgtgagtgaaatatggctgttatcaatccatactaccttgtaagatgactggccagcttagtctgcaataacaaacaactgcagaatctcagcgcttaaatcaacaacaaaaggttatttcttgttcgtgctatgattccactattgattagatgggagctctgtgctgcttcatgcttattcagccaatagagcctccactgtctgaaatgttgctagtggccatcatgggtgagggaagatagcaaattatgatctggcttttaacacatatctttgtctaaaagactatgtggccctgacatttgtcactttgagacaggaagtaggctggaagaggaatgtgtcaaatatttggtgaccagaaagttgagtagtcattatttgggattcccgtctattctggttctcttcttctgcatacatggtagggttgcactttgatgcccatttgaattagccattggccagtgaagtgtgcataaggatgatgtgccacttccatgttgaagcttcaaaatctagcgtgcagtttggaatattctttcctcctgtccaagtgacccatatgtttatggctctgtcagtctgggtttttgaatgaagacaaggtggagtagattgctcccaccaacctaagatggatgcgtactatgagcaagaaataatagatttgtgttctgtcattgagatttgaatgttgtttggtctggaacatatcctagcttattctaaccaattctgatagggaacatattaggataaatttccaaaagttaaaaaaaaagttttcttttgtttatctagatatatatctcctcaaatttaatgagcccagaggcaatttttcagtatcatagggagaaaaaaattacgtaggctcctttgattggttcacttgattagtggtaggggtgctggtgttagtaagaggtcatatttgggaacaaggagctgtctatattaattatagctgcaggatgtggttgggctgtcaacttcttttctgctagacagaaaacataatttagggatccatcacaaatacatttatcctaatgacaggatatcggagagcacatgattttcatacacactgtctttcctttctactttttctttaatttaaatgagtttattatatacttagatattttaaagggaagattcttaatttcttagctttgttttatagaaatcaatgaagaaaggagggtattattggcaagtgggaaaacaataggtttgtattccaagcagatggtttgtggacctcaaagatttcacattctctatcagtcctgaaaattagacagagttatgaaatcaagtacagagcgtactactgattcgctgtgtgaccttgggcaaggcacttaatcactttagatcttagtttcctcattttaaaaatgaggataataatactggcataagtcacagggatgttgtgtggataaactaattaatgattgtaaaatgctttgaaagtgcaaagcgttgtataattgttaggtgctattattaagaagtattattactgtgttgtgtgtaattcttattagggcttctctttgctttgaagtcagcctccacgtggactatggggttgggataagtttacagatgtgctgctcaagtgccttttttgcctggagaaaatactcagtagctagggtaatcatcattatgaagaggatctcttcaagataaaaaagataggaaatgatctcctttttaaaaaatggaaattgctctaactttaaaagtatcaatcaattctttaaaacctcatacagccctatgtttcaggaaagtctaacatcatgcaaaatttgaaacttcaggaattttctgctcagcataacatgggaaatgttgttgctaagataactttaaatcagctgaaccagctctttctaattttcccacagtgtttgcttcaaggatgaaaacaagtgaggtatcctctagaggagagaaattctgagctgtggctgtgttttgcatgtacaaaaagttaaaaccccaatccaaattaatttttatttgttttgtagattctccgttgggaagtgtgtttctaggtacataaaaacgagctatttttctgaaggtcaagtatacaccatgtttatacgtgactacctggtgcagctgagcaatattgactttgatgcaaaaagaccacagtcaggccttgggaggatttctcattagctgtgtgagttttaacaaaataatttaacatttgcctcagtttccatatataggaatgtgtgtaaaataattcctgcttacctaataggctctggaagagctcaaagaaggtaaaatctttggaaaatattttacaaatacaatgaaataattaaattgtattacattattttatttaacattttaatcatttttaatgtattcctgagttaacaagcctctacatatatttccattggataataaagatattagaaactcaaataattttcttgcaatgatctacatacatgcctttagttttatatcccatgacatgaagagaaagaagtccatatgcactttctgagaagttgtccgttaagtaggtcaaggggtatctgagatgtgagcgggtagctttggtcatttgcttttctatgattgcacacctttttaaaaaaaaatgctgtgtgcagtcatatatgtgtacagcattaccttttaaaatcaccaggaactaggaacataggatagatttgtttgctatgcaaatgaataaaacttgtaccaaagaaatctaatgtttaactccaagacacaaaagagttgttagagtttgagcttattgtactatcataggggataaaaacttccagaaacttctgagaggccagaagttttcagagtctagctttctaggatctgaggacgaaagtacttaggtctacccttgaggcaccattattttctaccaaacatttcacttcttgtgatcgcctaagtctttgcaagaagaacaaatctcacaatccatttatttactctcctaaaaatgttgaccacgtgaaatgacaatcagtataccacagttgtttatcccctcagtggtgccagagaagaggtaatggcagagtttgtaaggtttgctttctaatttttgtcttactggcatattttctatggtagatgctctggtgggtacccagatccccctttcagaaccgaggcactatttccccacctactggaagtgttgtctgctgatgactcacggctaagtccctctactggacttgactgctggtgcaggaagctgccctctccaaggtaatgcctgcctcccaggggctagctcacatccagtgactcaacaacatagatagtacaaagccacagccccttgttttgatgaggaaactcccaaagactatcttaatgccaaagttctctgtaagtttggctgagacctgtgttacaactgaattacagttttttttgttttttttttctcaaccaaccttgaagccatcaggctgatatctagggtcaattcccaacataacatggacaagaatatactgggtctgctatggaaggaagctcaaagagccatgtgttctccaggaattgggagcatatatgttggactggatccagagggtgctggttcaaagtggttggaacagaaagttgaataagggagagtttatgaacgtgggatcacttgctaatgatagagaatttaacaccctggcaagggctttgggagatggtgttaacatattgctaaaatgattcttgaaagcttggtaaaaatgatgaccaatactataataaatagaaatgccagaattttgctgtagcagacagtggatgaactaatcaaaaggctcagagaagttgtgttggtacacagagggctgaaaaactaacagatggtcgtgttctggaggacctggagccaaacagataataaaaatattagtgagaggagcatcatcatccctgaaaagccagtggtagccatcctctgttgtccaaggttcactgaaaagatgctgttacagaattggactctctgatagcaaagaaaatggtgatgagcataagtctggcccctacaaaaaacatataaattctagtgaatgacagagggctatcacaaactcaaccaggcttcaagtacatggttggcagccattgatctggcaaatccatttcttctcatcttatcagggaggaggaacagaagcacttcacattcacttgaattagataacagtaaaaacttacagtcttgccccagggctatgttgtctgtcttggactcttaaggaacctggactgtctggacatctgctgaatctcacatggatctgttatttgatggcataatgtttatcagacttatctgcagtaagtggcaagtcttggtaaggcatgtgtgatctagaaggcaggaggtagaccttatggggatacaggggtcttctccatcagctttaggtgtctgaggcatgccgggacagcctctccaaagtaaaggagaaactattgcaattaagcagtgagacacgttaagaaggaaacacaacatctgacaagcctctttgggttctggaggtagcatacatatttcacacttagtaatactgttccagtcttttactaagggacattttaatgctgtcaactttgattgggttttagaatagaaaagagctggatagcaagttcatgccacagtgaaatcagccctgccactagagtcatataatctggcatctcttgtgcaaaccccagtaggaaaatgacaaaacagaaccatagggttaggagcaaagacatgccctctgcagctaataattatgcacctttggaaaaataactttagtgtgtgctactgggtgttggtagtatgaagcactgaaatgaaactactacatctgggattgaacacagcaaaggccagaaggcagaagaaaactgcatgagcaggtggcccctttccacatgtgagggaccacagtggaaactgcacttcttcctctgctcacaccaatagctgcatccaaggtgggggatgttatcctagttgataaagaaggaaaaagtatgagcttggttcatgaatttatcagcttattagatgaatgccagccagaaatgtactgctgcagcactactacctcattcaaaggtgcctctgaattatagcaatgagaggaaatcctcccaaaggtcagaggtttgcacattgcaccttttgtatggtccaagttaagaatatacacaaattcatggttaatggtgaatggcttggccggctggtgagggacctaggagagattgaaagattaggctgggtgtggtggctcatgtctgtaatcccagcactttgggaggctgaggtgggtggatcccctgaggtcaggagtttgagaccagcctgaccaacatgaaaccccgtctctactaaaaagacaataattagctaggcatggtggcaggcgcctgtaatcccagctactcgagaggctcaggcaggagaatcacttgaacccaggaggtagaggttgcagtgagtcgagatcgtgccatttaactctagcctgggtgacaagagcgaaactcagtctcaaaaaaaagaagaaaaaaaagaaagattaggaatgagggggtataggaagtggtatatagatggacctattgaatggtcatgaagtgtgaagatctttgtagtatgtatctgttaatgcctgtcagagggcaatcaccaccgaaaaagctctaaaaataaaatagagaaaatgaccgtagtcattggccactccaatgctgacacaatgattgcatgaatggagtagacatggtgaaaaagacagagtccatgaatgggccatatggcatgtattcccactcaacaatattgacctggccactgctgttgccaaatgcctaatctgacagcagcagagaccaacactgagcctccaatatggcaccatctctttgtgagaggagccagctagttgtcaatgaatatcatcagcccccaggtatgactttgcctttcctaacttctgaagctcagctggcatcactgtttgagggctttagagtttctgggttttttttgttgttgttgtttttcagatggagtctcactctatcgcccaggctggagtgcaatggtgcaatctcagctcattgcaacctccaactcttgggttcaagcggttctcctgcctcaacctgctgagtagctgggattacaggcatgcaccatgatgcccggctaatttttttggtatttttagtagacacagggtttcaccttgttgattaggctggtctcaaacttgtgacctcgtgatctgcccgcctcagcctcccaaagtgctgggattacaggcgtgagccactgtacctgaccaagtttctgttctatcaacattgtgtatatattacattgctttagatcaaggggcacactttacagcaagggtagttgtgggggtgggcacattacattggatgctatcacatatcatacttcctagaagctgtcagcctgagaaacccatggcacggccttttgaaggtgaggtagtagtttggcatggcatctgcaaggaaccagcttggagatgatacctgtggggttggggtgccatctttcagatatagtatatagcctaaaataatgactattttacagtgctgtattcccagtactacaatcaataggtccaggaaccaacagaaaaggaacaggagtgtccctgcttaccacctctcctagtcaccctttagggacattttttgctttccacttttagatatttgggctatgtttacctagaattcctggttctaacacagggaatgctgccacaagaaggcgtggtaagatttccatcaaacttgaagttgcagctgctccctgcttacttcaggttcctcatacccagagaccagcaggcaaggaaaacaataatccatactggcaagggtaacgtatcctcaggaggaagtatggccattgtcgcacaatgggagaaaggaaaaaaatatttttggcacccagctgatccacttaggtctcacttagtaccccctattcaaacggacaagtgtgggcagctgtgacctaagacaggtgtggtgattagggactcagtccccttctagacgagggtctgtgttatataccagcaaacaacctggactggaagagatgctagccaaagataagaagaattggcaagggatagtagaggatggagacaatgaatatcagctgtgaccttgagaccacctgtgttgggagctatagtttgtcccactaactttcctcttgtaaatttctacaggagaagagatagactagaatcctcgaggacctgctcccagagagtgagaatttactaacttactatatgaactaggtggatctgagtggcctgaggagtgaactaaaatgcgtgctgtatgtaccacctcgatatcccctacagaaatgagacatccaatccttcagttgctagtagtgttgcctgatgatgattcaaaactaattctctcaatgggaattggcctcttctcaaagtagctgtctcaccaaggccatggttcctccctggcagtaacctgcatctaatgactgggcgatgtaggagcacagaagcccagccctactgccttgatgagcccattgtgaagggtcatctcaggttcagaggtcccattaggatcaactgaggtctctgttgtaagtgccttgtagttcaccttctccttcagttcaatcccgtttctctcactactttacaggcattgttcctgggaatactcctcaataaacttcctgcataacaaatctctgcctcagagcctgtttggaggggaggaaaacttagaactttgtccccaacatcaaaatacaatttaatttaaaaacatttcagtgaagttaatatgttttctgaattagtgcacccaaaaacatttccaagcaccccctttgtgtgttttgattcttacaatctatgtcctttattcattctatttattgaacaattaaagagtgcttctcatatatgaggcagtgtgccaggcattctggattcaatgacaaaaaatgcactcagaaaattcattctggattcaatgacaaaaaatcctgaccttaaggacctgatggacaaaagggaaaagcagataaattaatagacagttaaaatacactataattaatagaacataatgtgggaatgcagacatgggataactaatttagcttgttgagcagagcaacacagagaaaaatttgtaaggtttcccaaaagcactatctgatctgaacctttaagataagtaggaaataggtaggtaaggaatggaatatgttcagagtgggaagcagtgtgaggtaaaaagagaacaggtttggagaaaagaaaacacttctttaggatcagaccaaggagtgtggcagatattagtgtgaggtgcagagagctgttggcatctgtggagtaacttcaggcaggggagtgatatagtcagcttttcattttggatttattactgtagtctagtggatgtagagagaatggattagagaggagaccagttaggagttccttgcatcaatctagctgagaaacgatggctggaaatcatgtagtagcagaggacatgaaaaaaataaaataatggaatcctgagatttgaaggaatttgaactaataaatgtgggtgatggactggatgtggaaatgtagagtggttgaagataccctgtttggattaggaggtagaaatgctattctctgaaatatgtggtgagggtgaaggtaatggtggtaagtgtgtttgtatgtagggagagtattgcaggaaggctgagatatgatgacttttaattttctatttctatttcagacatttggagatgtcctaagacaattggctatgtggatagggagatctggtttagggaccatatcatacagacagtagaagccatggatgatctcattccaggagcacatatacagtgggaagagaatgaagctgaagacaattccagctccaaagatagtgacaagagctgttcatcttcatcatcctctctgtaggcatcttgaattagaagatactatttagtgtggtctcttacccaagataaataatctaagtttccgtaatctttcctcattgttctaattgtgaatttctttggaactttggtgatgttttctatgttcccatttagttctgagtaccagaattagacacattatatttattattatctttgacaaaaatagtgctaaaaaagccttcctaatatgccatatgcatcacggccgtaggaaaataggcgtaccacttgtcacttccctaaaacaggtgctcccaaaggcaattcctgcatgtcctagaggacttttgtgtgtgtgtgtgtgtggtctgtgtgtgtgtatttttaactgccgtttttgaaccaatgtaacatgatagaacatgtattaggatgtaattggttccaggttagttaagtaagaaatgcatttaattctttctcaccccttgaagaatatttctacttctccattaaataaatcagattttaaacaaaaatggaataatccctcaaatgtaattcaaaatacaacacacagtctcttgatttgtgagaattagctattgtacttcttcttttgaaaataaccctttaaacattaaaatcaacagatgacagctttagtaatctgagacaatttcatgaattgcaatatttacttatttgggaggatgttaaatgcttttaaaaattctttgtacctgatgtgaatatataataaatgtgtagagtatttcagttgcatgtaatgattgtgaagctgtaggaaaggtggctttcccaagtcttgagtgactgattccatcttttcttccctgactccttctctccaagtcttctaaaggtataacatctgcacagatgcagggaaggactgcactacaaagatgtgctgtcaatgagctttgcagactggttcttttccctctagccaagccttttttctttttatcctaaagaaccctggtctctttttatttcctggtcaatcttaatttttctaattttcaactcaaaaacactgagatttatctccatttctctgtcttaaagagaaatatacacaaagcagtcagagcattagctaactcagatcctattatgtgctaaggtctatctatctatctatctatctatctatctatctatctatctatccatccccttttaagattcacgacaaccccatgaattggtactattattatcttctcttaaacagaggcaaaggaaagctaagtaacttgtctgagatttcctggctgtaaagtggcaggaccaggcttacagtctccacagtttggcttttgagccaaccctcttaaccatcctgttaccctgcctttcaacagtgtaaaacaacaggagcaattttggtgtgctgcggaatgtaattgggggatctgggtcagaatggagaaaaagcaagagaaatttttcataggcagccaagaataaaagagcctaagagcatctacaccgatttctataacttaggctgtaagagaagtaggaaaagcattttgtttttctgcttaaacttgttgcacagtagaggaagataattttaactaaacttgtttgaggctttaagaagtaggcctcagagactcaaaaatcaaagtgaagtgaagtaaaattagcaattgttttctaaaaattcatgtaactcttagcaatgatttaggctttccaaacaacgtaaattatatatgcagattacttctaattataatgcctttccttctagattattgaacacttacacaataggattttaattgattctcaccagcctgcatctctagtgtttgattaaaaatatgcccattgtcaagaaaataaattcatttaggcatttataagcatttgtagaagataggtgaacaaaatttaaattaaaaaaatatagttatctacatttgaaagagttccttattatttaatcccttttgaaatatgcttagaatatcctttcaaggagatgatctacagatctttatttgaatctaacacttttaaacattttccctgatgtacagattcttgagttttgtttttgtttttgttttacattttgccactcaacaagaacataattcacttacagaattatttttgtgtgtctgtaacagctgtgattttccaccttactaagcagtttggaatttatcagtacatttctatttgtcttattttttaaatttttaatattttttaaaagaatatatggaatcgttaaatgaaatttacaagagttcattgctttggactgagttccagcactaggcccaacagaccagacaaaaccagaatggaatcgctgtgccacataatcaaactgaactttgaaacaagccagtttttcaaaagaggagatttacagcaaccaatcagaaggggcccagtttacctgagctggcatgataaggaagtcgtctctgttttaattccataaggaaagtaactttgaaacaaccacttctcttttgttcacggtttctgctttttcttagcccttttctgcctataaagccatactcctgatcagttcattagaacactcattctgttttctggaatgagatgttgcccgactttagaattcaataaaagcctattggatctttaaatttaagaaaaaccgggccgggcacggtggcttacgcctgtaatcccagcactttgggaggccgaggtgggcagatcacaaggtcaggagattgagaccatcctggctaacaccgtgaaaccccgtctctactaaaaatgaaaataaaaaaattagccaggcatggtggcgggcgcctgtagtcccagctactcaggaggctgaggcaggagaatggcgtgaacccaggagcggaggttgcagtgagccgagattgcgccactacactccagcctgggcgacagagcgagactccatctcaaaaaagaaaaagaaaaagaaaaaccaattatatctttaaatttgttgtaattttgtcttttgacaggatctttatgaagttacatgccattgacaatctttgctgtgttgttgtaacttcaggtatgctactgcaatgagcatgccagttggactcttagacaatggccatctgagtaagaaaaaatttcagttgttttaaaaaataagtgtggtattcattttgtaatttattaaaataacatttgaattttcaaactagctattccctgagattcagaagtctttttgcctgctttttttttttaagatgaagtaatctggctataaggaatattgattatattagtctaaggacacttacagagaaagtaagcttactgtagtgtgaatgatgcttctctttctattaagggtggtcattctaaatatgactgcataaggaataattctggcaaaaatcagtccttcattttctcttaagatatttagaatttaatttaaatattatatgtcaaggttaaaagttagaaacatgtaaggaaatatttaagaacttacaatatgaaaacctgttttctttatggaactctttggttatatgattggataggtaaaaacaaatttgtaaaatatggtagatatgggaaattgtcaatatatttgtaattcatgcagcaaacataatatttaggaagtatgttattctgttttcttaagtacataatgataagggttcttttctccaccaagccccttttctacatttgtggttttcatttttgctgtttttatgttattattgatagtatctcaataccaacctgctattgttaatttgtgacattccttatttagtctggaaagtggaaggtagtagatagttaaaagtttttggtgtctgatacagagatgtttatttaaaagtatagtaaacaaaattaaataaattgagatgtttttgaaacatggcttctctaactccgaagaactttgtgacaaaaaatgatctcttatgataatattttaatgtaaaatacaagaaattctttgaattaaaaaacattgtcttgattatcaccatttaggcatatattgaaagttctcatttaagtggtagaaattatttgaaatagtgttagtttcctgtggctgctgtaacaaaccaccacaaacctggtgatgtgaaacaactgaaattttttctctcactgttctggaggtcagaagtctgaaatcagtgtcgcggtgtggaagtccagatgtgggggagctctgctgcgttcccgcagaggccctggagaggaacctttctctttcctcttcctgccagtagtggccactcgccttctttggcctgtggttgcatcactccagtctctgcctctgtggtcacgttgccttccccttatttgtctgggttgaatttccccatgtgtcttttttataaagacatttgtgattcattttaagcccatctggataatctagaataatttccccatctcagaattcttaatctcatttgctaagaccctttttccacagacggtaacatttacaggttgcaggggtatctttgggggccatcattcagcctactctggtaatctttattcatatttaatcttcttcaaaggaaattgaagccaatgagaaaagcagtttcactcaactactctgagttggtgataaataaaaaatccctatttctccaactggtgttgcatgtaaagttacctgctatatattgccacctggatgggctgccttcgcatgaactaaattcaaataaacttaaaaaaaccaaattcatcatcttttttcctgaggtagcaactcctcttggctccgaattctccttttagagtcaccatcatcccagttatcgaggcttcccttggcagtcatctctgactctcgcttccttctctcccacatcctgtccttaaacgacctccctcttgagttttcacatacttaaaacatcaccagacacataagtccattgaaaccacctcaggcctttttaatttaaagactggggtatcatcatagcctcctaactggccacctcatgttagtattcccctatggcattctctcttatagccactgggttaatattcctgaaacactaccatggccatctaattttcctgcatagacatattgtttggctccttatttcatctgaagttaaatataaactcagcctggccttgatttattttgtagcgttatttctgatgctctcctcacctgacactttgggtccaggagcattgctctcttcacagccccctgggcgtgccatttcccacaacccgccacacccccacttctgacatgccttttcccaccttgcctttcaaaagtctactcacctttcaagatccatctgagatgtggcctgaagtaggacatttccctctctcatttctaagtaatgtctgccacattaccagcttgagttacacttttccataagcttgtcatccctttggaggatggacactgaatgagcaaagatgatgccttgtccattgttaaatttcttcagtgttttgcacagagtaagcatttaataagcatttctcaaatgaattttgtaaaggccaccactggaagtaatttgctgttttcacatcgatttgtatattcctcctttccatgtgcttctttgatcacatattattcataaaccttgtgactgtttttcatgcctaacatttggtcacaattttggctttttccttcttatccctccccccgcccaactggagtttaatttattttcctatatggtcctgtcagcagaactgttcagagaatttgggcaaatcaggacttcctgagagagttttacttgaattgcctgtaagtctgtaaatgttgtggggcatagaatgataggaaagacctctggttttcaatgctgaaggctttttattgttaagatatccaaaataggcatagcatgtttaaaagtaaaaaccctggacctgctctctctctttcatctgaaattatgtgtttgccagagtataatagctctagacaggaagttatgccctcagggcataattcttgcaagggagagaataaaaagtttagactcatgtcacatcctgaatctcaatcccttcatgtctgggcaatctgcagggagaacttttgttctagtcttctttgccagagagaactctggggttagcattttagtccacagtcccctgatgaatatttattgagtgcagagtgcaatgaggatatggaggtgaaggtggtgtggcctgtgtcttcaaggagcggtgtccctatagttgtcagaaagaaactccaggaaaatcctaaagagggagtttaaaattgcagatatcacagttatacaatcagtgttgaattatttccgttttcctcatgatcagaggcccctggagaggcactctggcattgtcctagtattactatcctgtggctatttcaattattgcttgacttcttcccaatgctttcactcatcttgtcatggtttgggctagaggttccttcactacacccactagcaaaggtgacaaagccagatttgtacctagaaaagtcactaaaatgctccattttccaactttccaaaaagcagcaatactgatcatactcataagtaaataaagctcattgatattgaattatctctacccaaaaagaatgtccatcacaatagtgttcataaatgagaggcccttctttgcaatacaaaggtaaaaaatgcaacataaaattgtatattgtgctggcaattaatttttacttattaatacattataacagttactttctgcctgatgtatttgtcatttacaaagacacaagaccttatttccatatttcagtcagtgctttattttgatcaatactgtattcatgtatgtaactctcatatcatactcttgagttatgttgaagttttaaacaactattagacaaataatgaatgttacatgttgggtacaagcatcctttgaaaaatcaagaagataaaagcaaagccaagagtatatgattcattttaatgtaatactgggataaaaatgtgaggatgtgatgtcaaatggtaataaatgctgagttttcccaatgatatgagacaaatttgacagaatacaaaattttaggaacatgtttataaactaaattagtctaatgttcaatgggaaaagtggaatttgatttatttatgttttgctttactgcatttattaatttttaaataccacacaatttattttcaaggtttatttatcttcatgtttacttgatgtaattctattgctcattatattgcacagagcttgtcacctataagaataagagttctatgaaaatggatcattttaatgtgataatgaatggaataggagtttagcttcatttcatttttcatgatagaatttgtttcggaagttcctatcctccatatcaatgtcacgcccaaatatttctggcttaataggaacttctgaaacaaattctatcgagaaaaatgaaatgaagttaaattcctattccactctctgacccccgtctctcctctgtcttcctcctggcctcttgcctccccgcccttctccctccttccctctcttctttctttcaccggagggcactacagcatttaagcttacacccctgattgaggaccgtccctttcttagggactccagaagaaacacctgcaatgttgagacacgaaaggcaagagtgatcctggaaagccaaatgggtgcctgtagaagaggaaatgatgcacagggattttgctttgattcatcaccaggttgactaggtgaccaggcttcttaccattcatgtgatctgcacctgtgatcaaaagccttctttatattctgtgagaataaaagaggatggccacaaaatattctataatcttctcagtgtattgtacttcatatctacaacaatattttgagcacctactaatataagggactgtgccttgtatccaagatagaaaaaataaaatagctcctgctctatttggggaagaaggtcaaaatcagggtaagggaatccagaggaagcaaaaactgatactgacggagtctgtttaagtaaaggcactgaattgtggaaaggtaaaacacatatgaagactggaattcaaataagaaggtctcccaaaagctgaaatgcagaataatgatggtagataaaaataatctctgacctgagatggtttttcatactctacaaacaagatgggatttgttaatagaatacacctactgaaaaatgagactggagggagctggtgggaggaaggaatggcctgagagaacaggtgggggaagaatagagattcagaaagattccatcaaacacttttgcagctgccgttctatactggtttgaagtcctagtttgccttgatttacatgtgtctaacagttgactctactggtatatgtgtctccagctttaagaagaagaaaaaatccactctaatgacggatattagttgccacttaaagatgctcttcagatactagtgttccagttaaccattaaagatatataacccctgtacaagttggcaaccataccaggtcattgatttattatcattaaactgcctaactagtagttatgttgagatgaatgctgggtaaaatattacaatgaatgctaaatgaaaaatacatctcaggcttgtaagctcccaccttgtgtagtatttctgtgttccctgacaccctgaagcctaatcgtgccttctgtatagttttacatgtgtagactctcttcttcgttacgatttgccaatcccctgttgctcacattgtactacagcaataatctttgtcatttttgaattggtgtccaggtggttgctgtcacattacatccatttttaaatgttgctcaaacccactgaggtgacatgcagttttccaacagtgtgaattttttttttccaaattttttctcttcgatggaagaaaaatttgctgtcttctttgacagctggacaagtagagattgcaatctcctttccctctcagtattctctggcaacatcatgaataagcaacattttagatggttgacttccaaaaaatgtttcttgtcaagctcctgtcaggattttggaagtcagggaacaacttttttccagttgtgattttctataatttcatttctgaagtctgaattatgatttttttttctttctgggtttttttttctgtagtaaaaggcaggatgggaagaaaaagtagctcagttcctttttgtgttgatgtagagggtggtacatcattggaaatctataatgggattttctaaactggtagtttaattattgttatattttaagttgaattatctctatcatgagccaatgtctaaataaccttacagtaatcatttttatggtatcagatgattttttaaaatattattacatttcatacttacaaaagatactgggaaatacattagacatttcagaatttctctcagttatgactatgagaatgaaaagaaagtcttttaaacagtcctgggattttttttttctgctgctatctagtctacttcaagttgtaattttcagtggttcttgttggtaaccccaatttaggccactctagagataggcctcgacaggattatatatagagagagagctcagcttagtcgttgagagcatggactcagaagatgggccagccctaaacctgattctgccaggattcatgtgaccttgaataaatttcttaccctctcatttgctcagtttcctcatctgtataatgaggataataaaaatcatatttactccatgaggttgttgtaagaattaactgagtgaggctgggtgtggtggctcacacctgtaatcccaacactttgtgaggccatggcgggaggatcacgagatcaggagatcgagaccatcctggctaacatggtgaaatcccatctttactaaaaatacaaaaagttagccaggggtggtggcatgtgcctgtagtcctagctactcgggaggctgaggcaggagaatcacttgaacccaagaggtggaggttgcagtgagccaagatcgtgccacagcaccccagcctgggcgacagagcaagactatgtctcaaaaaaaaaaaaaaaagaaagaattaaatgagtgaatatgtgttaatctcttaggttagtagcacatagtaggcattgtgatggtaaaataatacatacatacctaatttatatccagcctcacattttggtactgggaaactggatatcttgttcaacagtggtattcatagtttaatctcggcagcaacaaagtgccctggggttcctgactgaggtagaagaatttataagtgtaagctgtttccattttagtgtagtctaaggtaaccctctcctttctttttttcctgttatgagtaagcttaattttttttaatatatagagtttacctttaaagaagttaacacatcattaagatctaggtaccttcttcaactctccccattcactcattccatttcaatttcatgtactccaatcaactttggtatgttttgaaatgttattattatttatccaactttagaaggttctggtagagttagttcctgaggctagggaaattcttttaattaataatctttctgttaatcaccccataatctccatcagctctccaatccaccctgtctgtggccagacaggactgtggtttagttcaattgccgtcaggatacacatacgcaattcagtgagaattttgccaccatttttcctctttcagaagttgattacagaatagccatcattcaatgaaagtctacaggcttctctaattctcttgcagttcacagtcctttagccaacagcaactctacaccatcaaaagtaggatttactgaggtatcacttaaattcccccttgatttaagttcttaagtttcaggaccacttaagtattatgaatgacaaatcaacactcacatagtattgcagaagtatagcttgagtaagtctaatggggaacactttttttacaagctcagggtaggggatattttttgtcactccctcaagcaagcgaactacaccagtagaattataaatcgttctcaactctccctccctttctttttgttccacctccagaccatagtaggggtttaaaatttttggtgttgttgtttacttttttggtacttcggggttacctgtggacccctttccagaatattttacaggcatacgataaagtgcaaaaacttacttaggaaatcagttttatggaaatatactgatcacgattttgaaaaatgtgaagactaatttatgtgcttttattttaacacattaaataacaacagctaacaacaggtcaaaaaatcactgcaattcccaagtactgatgggtataagtgaaatattgagatttctatagcaactggaatctaataggaaaataactgtgatttctgctgttgacatagtcacaagttttcctgaaactactttgcttttttccctcattcacaagtgaaggaaatgggaagattcactcagagattagtgaaaaggatatttttttttctaagttcatgaaccctaagtccctgaggatgcagacatatatacatctagttttctatccctgaggagctttatagtctactgggagagacaggtggcaaggtcaaagagtgctgagaagtggggccactatcaccccataatcttcatcagcccttcaatctaccccaaattatctaatacaggcacacttcagagatagtgtgggtttggttccagaccactgaaataaagtaaacagcaataaagtaagttatgcaatttttttggtttcccagcgcatatggaatttatgtttatattctactatagtctattaggtgtataatagcattatgtctagaaatacaatgtaaataccttaatttaaaaatattacttaaaaaatgctagcaatcatctgagccttcaacaagttgtaatctttgcaggtggaggctcttgcctcagtgttgatggctgctgaatgatcagggtggtggttgctgaatgctgggatggatgtggcaatttcttaaaataagaaaacaagtttgacacatggattgactcttccttttatgaaagatttatctgtagcatgcaatgttgtttcatagcattttactcacagtagaacttctttcaaaatttgtatcagtcctctcaaaccctgccactgctttgtcaactaagtttatgtaatattctaaatccttttttgtcatttcaacattgttcatagcatcttcaccaggtatagtttccatctcaagaaactattttctttactcatccataagaagcaactcttcattggctcaagttttatcacaagattgcagtgattcagtcacgtatttaggctccacatcttcaggctccagttatcttgctgtttccaccacatctgcagacttcctccactgaagtgtttgaagctgtcaaagtcatctgtaagggctgaaatcaacttattccaaacttatgttcctgttgatgtttgaattttcttccatgaatcacaaatgttcctaatgatatttagaatggtaaatcctttccagaaggttttcagtgtcctttgcccagatccattggagtaatcactatctatgtcagctatgggcttacaaaatgtattttttaaataataagacttgaaagtcaaaattgctccttgattgatgggctacagaatggatgttatgttagcatgcaagaaaacaacattaacgtctttgtacatcttcatcagagctcttgggtgactgaatgcattgtaaatgagcagtaatgttttgaaaaaaatctttttttctgagcagtaggtctcaacaatgggcttaaaatattcattaaaccatgctgtaagcagatatgctgtcatccagactttgttgctccatttataaagcacagttagagtagatttaacatagttcttaaggaaccaaggatttttggaatgctcagtgggcactggcttcaatttaaaatcatcagctgcattagcccataacaagagagtcagcctgttctctgaagccttgaagccaggcattgacttcttccctctacctatgaaagtcctagatggtatcttcttccaatagaaggctgttttgtctagattgaaaatctgttagttagcgtagacacttttattaattgttttagctagatcttctggataacttgctgcatcagcactcgctgcttcactttttacttttgtgttatggagacagcttctttccttaatcctcatgaaccaacctctgctagcttccaacttttctcttccagcttcctcaccattctcagacttcatagaatagaagagagttagggtcttgctctggattaggctttggcttaaatgaatgttgtggcaggtttgatcttctatccagaccactcacactttctccgtatcagcagtaaagggctgtttcagtttcttatcattcgtgtgttcactggagtagcacttataatttccttcaggaacttttccttcgcattcacatcatgggtaactatttggtgcaagaggcctagcttttggcctctctcagcttttgatgtgcctttctcactaggcttaattatttctaacttttcatgtaaagtgagagatatgcaactcctcctttcacttgaacaactagaggccattatatagttattaagtggcctaatttcaatattgttgtgtctcagccaatcgaaaagcccaaggagaggaagagagatgggcaattgctggttggtggagcagtgagaacacacaatatttatcaattatgttctcctttttttatgggctttattggtggtgcccaaaacaattgcaatagtaacatcaaagatcactgatcagagatcactataacagatacaataataatgataaagttagaaatattgcaaaaattaccaaaattgtgacacagagacacaaagtaagcatatactgttggaaaaagtggtgctgatagtcttgctcaacacatggttgccacaaaccttcagtttgtaaaaaaaatgcagtatccgtggagcacagtaaagtaagctatgcctgtatttaaaaaaataaaataaaaaatagaataaaatcttaggttgaatattaataaaataatgtttagaaaacattagtatttttactgttgcataacaaaatatccaaataaaacttacatgttttatatgtgaatgccactttacataattcccttagctctgctttcaaagtactgttgctgcccaatgtcatatccccctccatccatttttctatatggaaattctggagcccccactgggttttaaaacaaaaaataggttaaaagttaattgcagtctcttaacattattattatgtcagtgcaatgctgagaacttgttggttgagtgatggtggcagctgttacacagtggtcatatggcagattgtaaccctgaggcctatccacaattcaaagctcatgtcattgccagctagtgtgataactcatacctggcatttttgtttactagtgcaaatggcactgacattttgtgaaaacattgtaaaaagtttgattcatttggtctatttgaaattaagacaggcttgatgagctctaggagcattcacaaatttaaatttataaatagagatgttaaagtattttatattactttgtgtcataccattcataatgtactcttccttaaaagaaagaggaaaagaaaggagatattaagttaagtgtgttaataggttataccagtgtttgcatgttagatagtcatgtggtttagcttgttacttggcatatgtggccccgattgtcacatgacaaggcacctgtggtgactgtcctttgttcacagctgcagcctcagctcatgccacagtacctgaaacctggtattttataaagatttgttgaatgaatgtatgggtaggtaaatgaatggatagttggatgcctgggtgtgtggatggatagaattttttttaaaaaacccaaaacttccttaagctgtagttagtcatctataacatggaaataataatacgtaactgataagattattatgtgaattaaaaacaataatgtatataaagtacttagcttgcatataagtgggaaataaattgtagcattaataaaaatatataattctggttctattaaataactaaatattttttgccaataattaaaactgactgcttttgtgagtctaagaaacagcagtgaacttggattacagttttatattctttgcgtctagaaagtgatgtttcatcacaaggcaagggctttcttctcatgacaaagagcctgatgtagctgcttaataactgttagtaacactgaaaggatctacagtaaatctgttagaaagctgtgatcaaaaatgtgagtgccaatcttcaaaagcccatttcaaagcttgtttgctataatactatgtagtggtttatttgcctttctttgtaactcattaaattaaaaatttggatccatcctcatggggttttcagaaatggttttataatttagcattccaatgacacttcttatttgcagattattatatactagtttttttgtcccactgtctcaccccagtgtagattattaagtccatatcattgcaatttgccaaaactctctggataaatgtctatgagagccaaggctccattttacttgtttatcgaatatggaattaatgaactatcttgaaacaatgtttataactaatgtttatatgacagaaaattggtgctgatcgtagtgtacatatgcaaactaatgctattttgttccccttgcctgaactctggctacacaggcagaattatattgctgttgtgttcaaacttcaaatacaatagtaactccagatgccatttttgtgttcttgtgaacttggagtgggtaaccaaaagcaaacaacaaaaacaaacaaaattgggacaggtgagaggcagtggcatggaagggagtgtaggcaggaaacaaataatatgatgactacaggatactacattctgatgaagactttacacttatggattgaacaactgttagaaaaagatcaaacatattatttgcacaggggtaatgattattttagaattacttcctgtcagtgataaatagctttatttaagcaaaatccaacctcttgaaattgttctccccttcagtgttatttttgtcattattttttcttcacttaaattacatataactgtaaagctctttgaaaaagtatattatctaaatgcatctatttaaattgaatgggtattaaatttattaaacatatttacaaaatataagtaagacatgaatttaatatgagtctgttgaatttttcattgtagttgaatgaatgaataatatattctagtcagccttttcattttctggtgcttctttttagcacccatagactttcatatattgtaaacattttcttctctatatctagttttagaaaataaaatgttgggaacacagaattgacttctggagactgggaagtatataactaaagtaatatgtgtttgctttttctaatttaattttgattgtggtgtgcttaatttataatcttttaaaatgttttaattttactcaaatagatctgtacatactttttatactcaattaacataattatttagctatcatacttccgtgtgtaagatttctagagcatcgccataatgtagcactttggtttgcaggagagaaattttcatggtacattatttacttgcattcaagtgaaaatattgttaatattggttgcatttgaaggattctttcaaaagtacgtggtgctcaagatggatttaaatggaacatgcaagagacagtaataacagagagatcacattctctctgtaatttattttaatgccattacacagggaattcaaggcagataaaaaactccatttacagaaaccaaatgtgcagaaatggattgtcataattccagatgaaatcaataatacatactccctggcatattttttattagaaataacttggaaaaatttatattttctactaagtaaatatataagttataagaaataacttatatattaaataaataagttataagaaataccatatattaaataaataagttataagaaataacttggaaaaatttatattttatactaagtaaatatacaatcatagccttaagatcttttgcagcattactttccccttgatgaattacaatgcaattttctagcctactcattttattaaggaagctaatgactggagcaaaagtctaatcagctgccaatcaggattccttgaagtgcagagtgtcaaatattgaagcaatttttacaactcataaaagcacttatgttccatggtatgtcataaaacttgtgatgaaaatctagcattgatgaagctaccttatttctcaagtgtttttccccaaacaaacagctttcaaatttcaccaaatctttcattaatattcaagtctattaatatagcactattatgttatctgttatagtattatattatccaactatagcaagataattagttatatataaacgtcagtcagagaacttagtggattcatcataaaagctgtaatggtggaatttttttttccatagtaaaaaaattggtctttcttctgataatgttagagtgggtttttgtttttatgttacagaaacaatgaggctgcacactttgctttcaccctttgcatcattatgtttgcattgtttatttttaacataatggtacattgtttcatgaaaagtaaccatatttcaaatcattaattcacttgtcatttatcattttaataccagaaagtagttaccttcctgtgtttgaaggtactgtataattgtatttctttaccatgtcgacttcctgtctcttaaaacgcagcaattacgtgtgtgtttgtgtgtttcttcatctgcttcatgcatataaatatgtgcgggtgtctggggttttgttgttagctgagaggtgggaagtgtttccacacatctgaatatttgctgccgaccttcttgatgatccgtctgttaatgtttttatcaagctggcacacctcatgtgggatcttaataaagtaatcagcattttccctctaaaacaagtttgagaaaatcctagttaaactattctcttcaacacttgaaggccttggttgtacagcaagcagctactaattcaggaggatttatttggcttttcctgagttctctgaaaaatctatttgtgtaaaaagaacatactgcatgatccccagggctcctggaactgaaaactcaaggatttagacgaagctacccagtttgtttaatcatttgaagttttgtttcagcagctcatgctttcctcttacattttggcagaggcagaaatctcagatgattgtttttgggtacacatgtaaaaattttctcattaaccttgggggtggtgtaatgataaaagagataacattttgtttcaaaaaaataatactaactgagcacatatttcaatgcattgcaaatctgaaggaattgtcatggctaacaccatctcagtctcagtatttgtgccccagttttttttcaggtcaagaatgtagggaaacactgtactaagttctcattggatcccttgatgcctcataagacacccagacccctagctctcaatttcatttctaaatgtaccccagctactagaatctctctcacaatgatgacaaacatcctctttaataggacagataaatattcctgtcactcttgactgagagacaatactccaggtctaggggacatgatctgcaaggaacttcccatgattcaggcaccactattcctgttcattttttttccattgtcccgggatttacagctttcaggagtaccttcatgttactcttctcataagagggcaacaccatatttttctcactgaatcagaagacccaacaccacctctttccccagagcactgccatttgcatcctatccagctaggtagggcaaaagtgtctttcattagactaaggacctccacaggcagtgcttaattttcatttacctttgcctccatagtgccttatatgtagtgcctaaatacggatggtgggtgactgcttagagtaataatagctaatatttttgtgacattagaaatggacacagtggtaatacaggtcaggattataactcaaaatcttggcaatgtgatgtttattggaacaaaggaacctaaagatcagaatgctttctctatgtaagatgactaggcctgtaaagtagagtgggtcactattctacagaaacacagatatcaatatttacattacaaataagatatattaggccattcatacaatttacaaaatggttcattataggactcactaactgaaagtacccaggtgacattgaacgtccagtttattttcaatataatcttcctgaaatctctgtattaatttggaaaaagtcaacaaagtaaaccattcttaatgtaacaactggatttaaactagggaggatcaaaatgtttaggtaacagaaactagcagtccaatgtggatctttctactttctctctttttgcctttgcctttgtctacgtctactttctctcctttgcctcttctttgtttatttaaacatatatatatatatatctatctatctcacatactcagaggtttattgcttagttttgttttttataaaaatggagtcatactatacacactactctgcaacttatttaagagtatactatgaatattcagttgggtcttattaaagatctaacatcctttttaattgctgcttaatattttgtactttataccattatgtatttaaccaagaatgtctttattaaataatataatcttcacctatgccagttaatctgttattcttagtgatttaagctcctttctctcatctggaaaatacagcaataaataggtaaaatccacagtttctccttcaagtgctacgtgcaataggcccatgaggtaacccctgaaattcatgttttcttggaagtaatcagcagacctggagtcctgtgtatgtttgtgaactccagaggtccacactccttcacttcacactcagtgtcctccatacttagggcttctacccccctgcccagttttgttaaagaaattactccttgggacatggacaaaataaaagaaatagccatttgtgtttctgtatccaacacttctttgtcctgtcatgggttcagttagttctaccatgaagtatggactgtctggtaagaggaaagagttttagagattaatgagggtagcactagtgaaactagtctcaaagatggcatagtcaatttcctcagatatagaccaatactgatatctaaaaagtttattcttatgggtagggatgtctggatgatagcaatttaagtcttcaagggagagcatctccgttgcttataggaacaatcatctggactaagtcatgaccacagttctaacagggaaagtaagcaagatccagctcccgaagaggagtttgcattggctgcaaaggggatccaagaccttagctcagtgagccaagcttcagggaaggactgcagttcccttagggacatagaatgctaacaaagaactggttttggagcttggtcatggggctggccatacatgttgggggctggcatgtttatatgacaaggtatttaggctttccacacctaaatattcagctatatctctgtaagtgcatagatccctaaagagtttgccctgggtacattgtgctggttgtcagataagaataccgaggctaataccagggccctccctttgttagaactctacatctaataaacacccaggcttggttctcattgagtcacaggctgggtggggctgagcctacaggttgaatattctcagttcttgactctggatccaggtggagtatgcatagactgataacaacttgtttttgcagtaagtctgaagattaaagcccttagttgagccaataccttccttctcagataagtcaaatccacatattcagaatgggagcaggaggcagaagggaaaattttgtaacctcttaacagttctagacttaacacatcctactatcaatctgagtggatttgttccagatgcttgcatggctgagatatgcaaaaaactgtctccccatgctgattggtagcatctttacatgggcaagtcttcctacttgtaaagaatgagttaggtgtgtctgggacttactaaggagtctcaggtgttgacagcttaaacaccttgccatgtaaatatgtctgatctctcttccagttcttacacagttggctgtggttactgacttcttattttgttcaggtctaaatgaaattgatcttgatctattactttaccctaggctggagaaacaactttagtaattatctcctcacccctacttcccttttgagctttgtaaaaatgattaaggagatcagaatatatggcataaattatcaatggttcttctccattggaggttagagttccactgtcaaaaattagtaattatcattcttcttacaagtttaagactcaaatggaactgactttttcagcctatttgttgtctatggtaaactaacagcaaacagctggatgttcttctgtggttacataaccttaatggagattagttccttttatccttctatactgcttccctaccaaatgattagattttttgaggggcagatataaaccccttccattgtttaaaaaacattgttaataacccttcgcactacacaccaaagtgcagcctttaatatagttgccagaagcagttctgagtgaaacactgaaatgaaaagtaaactcatgtcatttggtctatgataagcattcacagtttgaaaaaccccaaacagggatagttaagttgcaagcactatttccagaatgagagttgaaaattatatacataatgtggaaacaatagatcaatgaaagggagtatagaacaaaagagagaagaatttccatagccactccatagaatattaggtctatagaatgtcaagaggggttatgtccaaaacagggttctaggatcagataagtttggaaggtacagaattaaatgtcattaaatagatttacttcttgcagtattactcattatgcactgtgaatttccaagacagggacagcgtatgctgcatttcccaaacttgtatggtctgatgaatccaccgaagacagtgcttttatagggggacgtcatgatgccaaagagaaaagagcttaagaaaggagttcaacaggtcaagaagattagtgcataggaacttacagaggggaaattggtgcctccacagcattagttagaactagaccctgatataataggggaccagaagaaaggagggcatgaggaagagaggactgggctgcacatcctggctttgactggaacatatttcccaaatccttggtgatcaaagccaaagtaaatacaaccaaggttatataggagtaataagtgatggaggtagggagtcagctggatgaggcagagactggaaatccttgttttgacctcaagcctcaatcctgaaccatattgctatattgaaatatagtcaagaaatgaatgtatcatgcatagtggcatgtcaggaagttcaagtgtgagaaagccactttgttataggcccaattcctggaggaggatatatgcctctccagatccatttggcttcacttgtctccacagctgtggcaatcagttctgcatggactccaactatcttcctgtggggactgccgaccagtgtctcatcaaatcccattcccactgcggatttctgtgttggtgctacctggggaactcaggctgaggcagtgtctcacctaggtagcagcctctgtttcttgtttatttagagagtaattatgaattcataaactttcatattattacaaatcttactggagtatctagtaggggcttagttatatgctaaacagttgtagtttgaaaagccataataactctggttatttgacagatatcaaggcagggcaaagagatacccaactagggtaggtcatcccatcaatattttggaaacatatgattgcctcacattgtatatccttatcattgttttcttttaattattttacatataagtttagacagttgactgttgggaattcctattcagagatttatcttttaaccccaaatgattaacctgtaagctgtgactttcagtgttctggtattaacaataattttacacatttcaaaattatagtggaaagtaattttaccataatattttatctcatataacaagagcatggtatttcttttgtcgaactgcagcttttgtagataccatacacattattaatttcaaacatatcatttattccactagaattccattttttcttacctaatttatttccctttttaatactgagaaaaacagtatgagattgactattgaatttaataagatagtaacttaacacaataactaaaaacattggaagtttaaaaacaacagttttttcctaaacctgactcgaaaaccattgacattttagcaaacagatgggttttatgtaccacataatgaggtcctgggctcactcaagaccaccaggttgaaggaattctaaagctggagatcttttaaagatggcaaaatgactatgagattatctaaatatataattaaggaaaatagatcttttctgtttgtccttggtaaagtcctcaaggttgcatatgaccttccattaattttcttcagtcccaataggtgtttattttgccactgggaaagaattaggatttaggtaatgtctttgcctcacacttaggcttcctaacatgttataatgcactctatgttcatttcttgcctgtgttgcagtatagcaatatggtgaggactaaggtttagagtcaagcaattcaggatttccagtctctgccccatcatttattagccgtgtatacccttggttaagctgattaccctctctgagccttagctcatgaaatgagggccatataactcatatcactctgttgcccaggctggagtgcaatggcgtgatcatggctcactgcagcctcgacctcctggactcaagccatcctcccacctcagcctcccaagtagctgggactataggcattcaccaacatgtacagcaattttttttttttttttttttgagacggagtttcgctctgttgcccaggctggagtgcagtggcacaatcttggctcactgcaagctccgcctcccgggttcacgccattctcctgcgtcagcgtcctgagtagctgggactacaggcgcccgccaccaagcccggctaattttttgtatttttagtagagacggagtttcaccatgttagccaggatggtctcgatttcctgacctcgtgatcttcccgcctcggcctcccaaagtgctgggactgcaggcgtgagccaccaagcccggctgcaattttttttttttttttaagagatgagttctccttatgttgcccaggctggtttcacactccttgcctcaagtgattctcctgccttggcctcccaaagtgctgggattacaggcatgagccactgcaccttgcctactataaaccttaaatgatataacgtgttacagcagactgtgttaagagacctcatttgtacacctcaggtgttctttactgagaacacttcctattccttgcctttattctggctgcaggagcatggttggctcattccaaggcaaactggaagtctacaaaagtaatgcctcaaaaagcagtcccctatttagaatacctctgaggcatgttttacacgttttccagagttccccagcagaactgatgtccagtcgcccatagaagttgcttgcttgacagtacctctttccctttctttcctgaccgcatttctttgtccccttctagtaggtttcctgggatctcttttcaaataaattacttgtaccccaatttttgtctcacagtctacttctaagggaaaaataaggtgtgaaaagcacttagtattgtgtctggcacataatatattataataattattaatttcagaaacatatttaattcgttcttttttagaaaaagaaaccaaaagtgctatatttttgtaaaccactctcatggtagccacatcagttacagttatttttcattttctcttattgtttttaagaaatcattctttggctagtctcggtggctcacacctgtaatcccagcactttgggaggctgaggcggatggatcacctgaggtcaggagttcaagagcagcctggccaacatggtgaaacccagtctctgctaaagtacaaaaattagccgggtatggtggtgggtgcctgtaatcccagctacttgggaggctgaggcaggagaatctcttgaacctgggaggtggaggttgcagtgagccaaaatcgtgcctttgcactccaccctgggagatggagtgagactccatctcaaaaaaaaaaaaaaaatcattctttgaaaacttgttttctatttgaacagcaaaaccaggttcaacaagtgaatttgggcaatgactttacatgcactaatttttctgccttttaaaatacaattttctgacacctattttggtctggcagttcatctgaaaaataaaagcagaattttaaatgtgtaggtaagaaagattctattagtttccgacagcactgtagaaaaacaagagctctctatttcactaaaagcgctcagttccccctttttagcaaacactgaacattgatagtgtgttatgataaattaactacaatacctttggaggtcaagtgtctcagaaaaaagcaacagtaacatcttaggcaaaatggaaagcattagattcacacctgtaactcattaattttaaccaagagttagatttcacagaaagcaattactaggatggattgagttctttcatacacagggttgttttttttttaattgtaagactgttaaatattttctctgactatagttgccctcagcaatatccagaactagtggctatggattacttcattgtttctttctttggtaactgagaaaggtttaactatttattacaacgtttaaaaagttagattagaagaaaggatgcttccatctatttcatctttgtattctaaaagagtgtagctctactgtcagtggaataacagtgtgataaatgcactaattacatctgccatacaaagcttatatataaatccaaagtggacactgtgtgtgtgtgtgtgtgtgtgtgtgtgtgtgtgtgtgttttgagggtgtgcttgtgtgtgttcctgtctgagttttgcttctgtggttgttcatttgttaacagttatctgtttacaagctctttaaagatgaataacttagttattcaaacatgataaaatcgtgtttggtcgggtcttggtgttaaaatttacctgacctgactcttctcaaatgtctctctttacaaattccagtaactttattgctaagctataagaggaattttttagcttatttttgctttgagtctgtttttaactttctacaaataatttaatatcccttctctttgccttttcttaatgaagcagcatttctatgtgtctcctttcagggatgtatgtaaatgtagctatattgttgatagattaacataataatcaaatagaaattaacttcctgtgattcatcagtaaaactctatggacctacttttactcaaaattgttgctgtcaagcatttcaggtatgagttaattggctttctagaaaatgatagaggctatcctaaatctcaaagctcaatgatatctttttattttctgagatgccatttgtcaccatagcttattatacatgggctgattctcactccctggaaatagaaatgaagaaaggagctgtagggtcccctgccgccttctataaatgagcaaatcaaggaccagaatatctgtgggactcctccagaagctcttacagttacttacatagctaagtaagagcaaaggctggaagtagaacccacttttcccatagccaatccatttctcttttctaccaggtgtcttgtggcatttccccaggggactacatcttatctgctgtagtagaatcatgaaggtcatgaaatactggagctacaagagatttcggaggtctgctcccccccacccattttatacttcagaggaagaaactgagtacagagagttgggttgactaagaaattcatatagccaattggcgatctccttatagccattctaactttaaaaaggtggggattaaacctgctttcaaagcacaacctgaactgttccctcatccaagcttaagagagaatccatgacaccatataaaacagctctttatttccactggcaacaatggatgtatcctagttcatttgaacattttcctctctctatgatataggttagctggtttatttctatatccttgccaaaactggcagtgcatataggctgaaccatgcttgtggagaaaacactattcatatttcattatattaccttcagcagccctttactggcattatgactaaaacgcgtgtctccgagttgttgctggagaaatggccggccagtgaatttcgcgtcagaccagtgactattccagttgatatgaaagatgtcattactctgggggttatattgtggtcatcaggatattttctagtactcctggttcagaattttggagtattcatcttgaaaattgatgtctgtcctctattttggggggagattttctgtgtgctgtcttggctttctttgtttcctaggctataggtaagagttaagacgtacatgagtgtcttctagttaataaacctcactgccttctcacatggctgctgtacatacctgtcataacatgtatgtgatatactctctcccacacatacctatgcacacacagactcacacactctcacaagaagggaaatacataccattcttgccataatgttatttcatacatttgtgctttatttaacatttttcaatgcattagtattatgaactcttaaattaatgtaccaaagggcatttacataactttgaatatgttgattcaaaatcattacaaaatataatctaataagttacagagcctcattcaatgattccagttagcatccgcttctaagcgtgctattacttattcattagtagaagccctttaattttatattctgctcctggcagttgtggcttatttggtacttgttacagccactttagacaagtaaataaaaatcagatgaaaaatcctcagcaacagctggaaataaaccagtagtttctgtttgggtttggcagagtgaagcactgcagggctatgcatggaaaaataccagccagaactgttacacactgtgagaaaagattacatatctctagggttttggccttctaattactagggggtttctttgtccatgaagagtgccacctgcgtggttgggcaacaatataaaataattaaatcattatcacaagggtaatagtatacgtctttctggtttagctgtgataagaaaaccttaaacctgaaatacattaaacagtgtagaacatatgaaaagcctctttgagaggcttattcttgttgttatttaaaattttccttcactaatgtttagttcaaatacatgataattctagggaattacccgtctttatcagaccacccaaggaaggaagatgctctgccaataagtaaagccattggcctgtaagaacttgcttctgacttctaagtcacactcattttgataagcagatgtcttctaaaatgactgtgtggcttagcatactgagctgtttttctttccttttccaagacagtatggacatagttaaaaaaaaaaaaaaaagacgaaagattgttaagtacctgataatttcaataacatatttgtagtaactgcattgcagttaagccttatttaaagtaaattatctattttgcatccttttttttcaataaacagtttcacttctaagatgatgagggaaaaaagatgattaaggtttagcaatcttgttgcaagcttatttaaaattagttgtttaattatctacttcagatattattttgccaactggttatgttcatgccctgattaattattcttttcttccaagttatactcattttggaaaaatcaggtttagccatagcatgtgaagcccttaaaattgtctggagacagatatcttgatctcagaaacttaaattatcttaatactttctggagtaagaccaggaatggaagaagaagagagaaatatttctttatttttcctaattttatttcttctttcagcagaggaactgtactcttaaaattagagggtcagagcccttgctctgctgctgaatttatctcttacttgaggaattaggcacaatctaaacccagtactatttatttctccctttagaaattgaggaagttacctatggctaatatttttcaaatttatgtattttgtttgtttgtttgtttttttgggagatggagtctcactctgtcacccaggctggagtgcagtggcacaatctcggcccactgcaacctccgcctaccaggttcaagcaattctcctggctcagcctcctcagtagctgggaatacaggcacatgctgccatgcccggcaagttttttgtattttagtagagatggtctttcaccgtgttgccccggctggtctcaaactcctgagctcaggcaaaccacatgcctcggcctcccagagtgtgggattacaggcatgagccacattgcctggcctcaaatctacattttaaaaatattttaaaatagcgattttcaaacattaatatgatcagaatcacctgcagggcttgccaaactctagactgttggattccacctctagagtttctgattcggtaggtctgggatggatctcccaaatttgctttctaaaaagttcccaagagatgcggttgttgctagttcctgagatcacactgtgggaaccaaagccttacaataactagcctttttcatgagagaatggtaaggaaatataccacatatcaagagaagttatctcttgggttatcggaatgttagtaattttgtacttacccttttttcctctattctccatatgtcctacaagttatgtataatacatatatgattagaaaaaataatgaatgtttttggaagaacacttgttgaactagaaattcattaatctctattcattcttcccttctgatgtcttgtagcaatataataatgtcagttctcctcacctgctggggacagacactcctttcgatgtcttttgagggagctttcactcagcaaccaccagacagttgcttggttccttttagagtgctgtctttattgtgccagaatttagtacaagaggtgctggctctccaagatgagcaaatcccttaattgtatttcaaaaattctccccagttttttttctctctaccctcctcaggttacaatgctaaaagttctgtgtgggcctaaacactagtgggaaaaagcgcctggtgaacaaatgctgggtggcatgcccactcagacataaagaagttctgctcacccttttgggagtgtactcatttttgagaaatttgcctcacttagagctccttaaaataaatcaaacaaaattatatataaaatatatgctttcacaatttcagccatttcttttggtgtttctcttctaataaccttctaaacgttgttgctttatgtttttatctcagatttttgaaaacaaactaaatatagcaccctaaaaaacctttcaaatattttggattcttttatttatgactcttacaagcatgtgagggggcttgtttagagagaataaaggttataacctggtctgtctgttgagacagtgattttaatcacatttaattcccattcactctgtatgttacttgatccactcattggtttaaaagcatattgataaatacagccatggcttagcctcttgcccttcatcccgtctagagttgcatccaggcttaagtgagtttgccacatttagatgtcatactttgttactgatgagatccttgctagatagtggagcctatgtttttctagagaaaagtccatattccattataaagataaataaataatttgtttcagaaggctttcaagatgttggcttatagtcaaactataagtaacagcttgaaaaacctcagtgcttctcacatacatgttaatggctgttctccttcataaatactttgaagtgtttcagtaaatattttcctaaagaactttaacttatttgctaacttattgagtatcaaaatgtatgttgtatatgacactatgctaggcatatatatacaatattatccataatttttctaaatttttttgcaaatcagataaatttttattttaagattcagggggtacataagtaattgttacatgagtgtattgtgtgatgctgaggtttgggcttctaatgatcccatcacccaagtagcgaacatagaacctgataggtaatttttcaacccttgtcaccagccctcgatttctccctcctctttttggaatccccagtgtttattgtccccatctttctgtctatgcatacccagtgtttagctcccacttataagtgagaacgtgcgatttttggttttctcttcctgcattaattgacgtagtgtaatggcctccagttgcatccatgttgctgcaaaggacatgattttgttcttttttttaatggctgtgtagtattccatggtacatatgtaccacatttcctttatctaatctaccattgatgggcactgggttgattctgtctttgctattgtgaatagtgctggggtaaaaatacaagtgcaggtatgcttttgggagaacaattcattttcctgtgggtatatactcagtaatgggattgctgagtcaactggtaattctgtttctagttctttgagagatctccaaatggctttctacaggggctgaactaatttgcactccagccaccagtgtgtaagtgttctgttttctctgcaatcttgtcaacatccatgattttctgactttttattactagccattctgactggtgtgagatcctatctcgttgtggttttgatttgcatctctcgacatttagtgattttgagcgttttttcatatgtttgtttgccacttatatgtctccttttcagaactgtctgttcatgtccttggcccactttgtaatggggttatttgtttttttcttattgagttgtttaagttccttatggattctggatattagacctttatcacatgcatactttgcaaatattttctcccattctataggttgtctgtttactgtgttgatagtttcttttgctctgcagaagctctgtagtttaattaggtctcaattgtcaattttcggttttgttgcatttgcttttgaagatttatcataaatcccttgctgaggccaaggtctagaagggtttttcctaggttttcttctaggtagagcaaaactttaaatacacatttaaaaaatatattttcttcagaaaccaggatgcaaaagaaatttccaatattcctatattttattaataaatgtatgaatttgagcaatgaaagaaaacatctcaattcttttcaaaaaacacattttccttctttttggtgttgtaataatatgctcccaagtgacatggaagtgactacttctactggtcatcagtggtaggatgggagggtaccaaatctggcagcaaagaagtttacaaatcatattgtaaaaaataagcaattgtgagaaacggttattgcaataagttccagaaatcattatggacttccataaatcattaaactccatagcaaacttaagtacattttagttggattggattctggttcagaaagctaaaaaggacattgctgggacaattggcaaagttctaaaaagaactaaaaaaagatgatagaactgtaccaacatccgtggaacagaatagagaacccagtaataaggccacacacctacaacaatctgatcttcaacaaacctgacaataacacacagtagggaaagaatttatttaataaatggtgctgcgataactggctagccatatgcagaagattgaaattggaccccttcctttcaccatatacaaaaattaactcaaaatggattagagacttcaatgtaaaacccaaaactgtaaaaaccctggaggaaaacctaggcaataccattttggacatagaaacaggaaaatattttatgacgaagacatcaaaagcaattgcaacaaaagcaacacttgacaaatgtgagctaattaaactaaaggccttctgtacagcaaaggaaactgtcaacagaatgaacagacaacctacagaatgggagaaaatgtttgcaaactatgcatctgacaaaggtctaataatcagcatctataaggaacttaaacaaatttacaagggaaaaacaaccccattacaaattaggcaaaggacatgaacagacacttttcagaagaagacatacatctgaacaacaatcatatgaataaaagctcaacaatactgatcattagagacatacaaatgaaaaccacaatgagataccatctcacaccagtcagaatggatattattaaaaagtcaaaatacaacagatgctggcaagattgtggagaaatacactgttgatgagagtgtagatagtgtagattattttaaccattgtggaagatggtgtggtgattcctcaaagacctaaaaacagaaataccatttgacccagcaatcccattactgggcatatactcaaaggaatataaatcattcttttatgaagacacatgcacacatatgttcattacactactattcataatagcaaacacatggaatcaacctaaatgcccatcagtggtagactcgataaagaaaatgtggtatatatataccatggaatactatgcagccataaaaagaatgggaccatgttctttgtaggacagggatggaggtggaagccattatccttagcaaactaacacaggaacagaaaaccaaatgccacaggttctgacttctaagtgggagctaaatgataagaacacatggatacatgggggaacaacacacacaggggcttattggagggtggagggtgggaggagggaaaggatcaggaaaaataatgaatggatactaggcttaatatctggatgatgaaataatctgtacaacaaacccctctgacataggtttacctatataacaaacctgcacatgtacccctgaacttaaatgttaaatgaaaacataataaaaataaaacagggatgtatacacacacacacacacacacacacacacacacacacatgcacacatatatatatataaaatgatgtgcatatataatggtcatatatatatgaggtaaaatattaacaattgagaaatctggatgaaggagatatggagatataggagttctttatactggctttgcaaattttttaaaagtttgaaagtattttaaaaataaattatgtaaagggatcataccatatgtagttacgcattaattgtcacaatgtttctctgattatttacatcatggcatttagctttacagttaaactatttgtacaaactcttggtcatataacattctgagaagacaattaattttggctttgaataaataaaacactagaagaattgttttctccttaccactttgtgtcttatggccattaacaaaaaatactgatagattgactttactttttatgactcttttagttttctagttctagaacgtatattacaattttaagatctaattaaagcactttatcgcatacagtattgtctctttttttcactgttgaacaacatatttttaattttgaaattcttcttttccattactaatggtaagaattagatgattgttggttttacaaaaatcacaatagatggaaaagaaaacactgtattttctcacatgtgcatcaaataccagggttttggctcataaatcagaagagcacaaaaagatacaactggagtccttcctagttccactgttacagccaaaatgctgacattcaggcatatttccaagacccacgtttcggtaagcccttatgtgcttcgagtgggctgaaaagaatgtgaaataatttcacatggcaccttttacagaaggctgtgtgaggaacacaacattctctttgaaagagaaagtcatctttgtaataataaccattggttgctttcttttttttaggcatgtaataacattagaagatttactttggaacttgtttggaccattatcaacacgttagttttggtgacaaaatttgcatttactactgtagagctgtaatacctgaaagatgcaccatcctgacttgggactaagagcagctctcaacctcttttattcccctcaaaaccaacaccagtgcacaagtacctctgatattagataaaataatgaagctcacagtaattataatgcctattattttatcagcatctaccacgttctaagtgccttacattcttgatccaaactaatcttcaaaaccatccttaaagaaaaaaacttttcatgttacaaataaggaaactgaggcccaaaagagctaagcagcttgcctagcatcaaaatagtattgatggacaagaaattcacctgttctatgtcactctggaacctgtgcttttttcacaaaacctgtctgaagttagaggggtaacaaatggttactagcatggctaagagaagttacatgtggacagcactcggatttcaactagttggcagattatgcttgcttcagtggggtgggaaaactgacaaatcctctgacattagggcaaagaactttgttagatgtcatcattattacaggtgactctgatgccattttattaaaggctgtatcttctttctgtttctatctacaatgcttagtggtacacaacgcatgacaggtgcctaggaagtctttgttaaataaaagagtgaatgaaatatgtaatagagtaacttattgaatggcagcttaatggccttagtgaccagaattaactggtcaagagttaggggggtattgccagttaagatttcaagaacagttttttttttttaactgcagtatgggtgaagaagggtgaagtagaaaagtttacaaagaattaagaactgattttgaaaaatgataagccctgacctaatgaattacattttaaagcattctttagttatggaataggaatatataaaagcagtgattatcttcttttttcttcactgtttccaattggttgtattttttttttctctcctcagctggaaatgcctaggttccacagttacaatgtctgctgattttatattacttaagtcttgtagttttttcctttaattgtgaagccattcttacctaagttcaatcatattggaataattttcatactcctaaattagtatattagaattttttttcctcaacctatctttactagcataattaacttacatatatccatcctttagatttcgttttcttccacagtcactggaaggtggttcaaattctccagggcacttttatcttcccattcaaaacatgtccatttacattctccctggattgtgaagcattatgcactccatatgaatgtggaggcaccattttcttctgcctcctagtaataaactgctgtttttcatcagttttaatatttactttcaacagaaactgtcaagattgccattatactatttgctaataggaggcctgccctttttaaatatgctttttaaaaaaacccagattccttttctacagggccgaaattaaagcaggttatgaccatggcccgtgaggcatggttttatgactctgctgaaatctcagcctcctgctcctccccttgagggataagaagcaaatatgctttggtaagattgatgaagcaatgatatccccaagtatattcctattaagttccggtttcacagaacttacaacagggtaaaacccccaaataataactttctccagatatttatgatacatagtttataaattattacctagcaaaaatactcttgtatacaaataatcagtattttcttcaaagagagcatatttctggattaatttctgaaaacattcttagcagggaagtttccagaaagttggggactttctgtatcccttgacttttgatttctgtgcgacagagctcagtagtaaattgtccttaccatccctcatttaccttctaaggtactgagtcattgtagaatatttttaacatcttgtgtttccagacattgcttcatttgcaaacttaagaacatttaaatatttaagagtatttattttttaaaacagagatttcatacaagtgacacagctaagtccaaacactgtattatttatgtccccagcgcttgactttttgagtttcttttcttaatatttcagttctagagatttcatgtgatatactagataccaattactaaagtgttgttcagagagcagagggttaaaatgttttcttagtgaattctttaaaaactgtagctgtggaagcaggattgctcttgtttcatcctgacaggaatggtagatttaataggttccccagagctttttatcgcattataactctttctgtgatggtcagttttgggtccacattatgtgacctgactttcaacttgtttgaactgctgtcaggctgcagaggaactgaaggctactagatagtcctgtagttttccagttgggaaaacaacaatcctgcctgaaaacttctgacaagatccaatactgttcttcttatagcaaaactgagtcagcctgatacctggaaaaatctttacctgctcaaagtaaagcagtgtggccagaatgccttatcgtaatgtaaatctgtgttgctttgctctataataacagcttgtctatctcttgtgatcattcattccctgaggttgaaactattatcatgtcagcagagctcccttctcagttagcttgcattgctagccagcactcctgtataaatcttgatgtctcctaaatgttctccctagatccagtgtgtggtatttaaattaaggaagctcagacatgtcttgaaaggaactgaagtattgcatttagtcttgccaatccactgattaaaattcttgccaagtgttacattatgcacagcttccttattttggctgtaaatttcattgcatatttttctaggatgagaaagtttgtactttttatttcataagcccacataataaacacagctttcttcaaaaccgtttgaggtgttggatgcgtgtgctgtgttaaatatagggctcctttgtggaggaaagcacatgtggctcattttaacttcacacacaagcattttagacggggcaaaatggttctgctgggtaaaaagaaaatagacatttcgatgagctgcaggattatccaagccatagctttatcctctctgaaatctcttctatgcacttgaagaatgaacaaaactttctttatggacacagaagaacccactctcttctctcctatagccactgccactcattctgcccctgtattttaaatttttagtgggtgagtatgtgaatcgaaagctctcagagctggggggtggtggctcacacctatgatcctagcactttggaaggccaaggcaggcagatctcttgagttcaagaccagcctgggcaacatggcaagaccctgtatctacaaaaaatacaaatatttgctgggcatcatggtgccctcctatagtcctagctacttgctactcggggactgaggcaggaggatgacttgacctcaggagtttgaggctgcagtgagctatgattgcaccactacactttagcctgggcaacagagtgagaccctgtctcttaaaaaaaaaaaaggctctcacttttcactaaataaatgcttctctagcataaaactttgtgtagcgtcctttcagctaccattctgaagagaaaaccccaatgtcttagagagggaacaaatagatttagagggagattagcagaagccataaaatgcatactttggacccaatgactgggcctgcatttggaataaggggtagaaaactggataattcgctccatttacttctgtaaatgtatttttctttggtagcagccttgcaggagaagggcatctttgaaggtctggaggtggggctccactgacattcaaataacgcaggcctagggtacagggactgaaagctcactgcacttttgattcggattgggatcctcccataggttccattggcaaatgactactttcttaacaaaaagaaatagttctataattaatttttcttaaggaaaatcatatctcaacctattaatttagaaatattttaaatgagtacatggggatacaaatttagttatacaaatcacatgtgacactgttcatgctgttcgtatttcagtatagattaaaattttttaatgctaaaaagagcttttcttgctcttagagttttttttcatgcacatttccatgaaaatttagaagttatgagggcaaaatcttcatctatacacaaacacttttttttaaacaaaaaggagtaaaatttcatcaacattatgaactatgagccctattgaataattttttcctgtaaaaaacagaatcaagttatgaaatgaagaaaataattaggtctttgctaaaacttagtctttattaagcccaactttttcttaatcagaaaaagatgtcaaaaggaataattgtattgcttgacaaagtgatcaagatgttttctgctcctaagttatttcttcatgtgacaatcattccttaaagctcctcttaataaataatggaaagaaagaaagttgatgtttggattggggcaataaatgtcatctttatgtgtgtagtttggagaaacgggcttcttgtttgccatctcctctccagagttacagatacagtgtcattggtccttttaaaagtatggaaagcagagtgaatggcaaaaggtttgccaaaacagattatcttttgtatgcgtcaagattttatatttttgcaaatatacatacacagacaggcttttcaaaaccattttccttcagacatccaagtaaaagttcagagtgatttcttttttgctccttaatatttttaatcctttatcatcttacctaaagccatttagtatttcctggagcagatggggtataagccataaaatgacatatttacttctttgtaggaagaaaattaggagaagagattctataacacgattgaagtttaaaagctaaattccttgaggaaagattatctttctccatagatctcattctctgataaaacaaatgaggttgtctcagaggcacctgttaatattgacctacatcatccctagttctgaccttgtgtccccagccactgggaagtttttggtagaaaaggaactattaagttggttcgtttcttatttcttggaaagagaaaggtctccctccccttgcacttctgcttgatctggtctctgaaggagacttccacagaaacaagggcacaatctgtgccttgcaactacgcctatcatttcctctttacttaaggtcaaaatttccattactgcttagactctattaataatgggtttgaagattattttggggaattattccttcaaggaatatagtgttaggacctgcgccttgagaagggtctctgcctggatggaggaacgaggatgctcttgagaaagaactgaattgtgaattttttcttttcaagtaaatttcccagttgttttaaaaaaaggtatgttgccgagcttttgaggaactcttcagaataccagagatgtcttcaatttaataacatcttacagcaccgttttcaccagctagtatatcctttgcctgaaaatccctgtcatctacgatgatgaatttactcctcattcagactgtctctctgaaataccagaaaaatatgatcttcattctcctctctggaccctttagtagtacctaacatgagtaaattcagcctcattgttgatggaaatatcccttcctggtgaaaactgacagaatctaagcaatcttaaggtcccatggctaccagtctggcacattctaggtttttccagctgccatttcttctttagtggtgtggtcagttctcctctggccccttcagtgaactgtttggggttttacccactctggcattgtctttacaatgtttcgtcagatcagaatttcccagtaatttaacacttctgtaatgaccaaagagaaatttcttatccagaatgtcaaggaatatgtctcagataaatgagatgtatgcctacaacatttcaaaatggcatcaggcttcaagttacagaaacaccatccacatcctaggtagtgacttacacaaaacacaaagtcattttttaaagaaaacaactgttttctctcattgaatgagaagtagttcagggctaatgtgactccttcacagatgatgtcagagattgagacacctcccaactgttctttctaccacaccatagtgtagtcagcacgcccatgttgactagatggctgctgaagtcttacccccatgtggttagtcttaggcaggaaggtggatgagtaggaaatcaataataataaataataaataaataacaaagatctgctatggaagtaagccctctgtaataagcttgcctggaagccccacctaatggcatccacctccatctaaattggtcactcatctctttttcatctttgaaagagatgctgataaatgtacattctaaattgggcatatagcctgcccactaatatagggattctgttaccagggaaaatgagaattgatagtgggtaggcaaccaccaatctatgtcataatgacattttctttgatttagaatttctttttaaattgggatcatgcgtatgtggaagaaaatgcatgaactaggtcttaaaatattttgtttactatgaatttagcatctgaaaaatacatctttaacatactctgggcaggattttaatgagcttgacttttttgctctcagacctaatgatgagatataggtcattgtttcatatttttccaagagattttaagggtctactgtaaacatttatgagaaacattttttttctcatttgctatttcaagttcagaaagaggaatgaaagtcactgtttcttgggtatctgcatattatttagatcttagagtctaggagagagaagcatctcttggtttttaaagatcagtccctacgtttttggatttgagatgaagaatgctagtgtgtgatctgtaactaaaaactgctccagtttcctgatgtgtaaatatttattctattatacttatcatcttctcctaggatcacggcccaaatctcatcttcaaattgaccaacaagatgaggaggttcataacaagttattttttaagtcagcccaaggcaggctcaaataaattaaccaaattcctcacatctgtgaagcttcaagatgtggatctccttgtcattgcattgtattttcttagagatgtttcttctgctccctaaaggaaacactgatgctattcagtacctgacacatgaatctttcatgcaggctataggtgacctctaatggaatccactttttacctgattacttcagctatattgtttttcctccccaaggggttaggacagctatttaaccttattgttttgtgtcttcctttgagagtggcttcttgctttgtatcccttctgatgaggatgatgatgatgatgaatatctgtgtaacaaaccacttccaaagtttagtgacttaaaacaacagctatttaattattgattctatgggttcactgtaaagctggacagttctttttctgttatctggcctcactcatatgtctggtcagttgccaggaaagctgaatgctggctagtctaagttggcctccgctgagatggcttaatcctgttccatataatctctcatccttcagctagctgatctggactagttcacatgggagctaagcagagttctaagagagtgagcagaaatgtgaaaggcctcttgagacttaggacgagtactggcacagagtcacttttgcctcattctattgaccaaagcaagtcatgagattagcctagattcaagtggtagggaaacagattgtatctcttgatggcaggagctgcagagtcatatggccaagggcatggatacaaagaaagaagtaattgctgcaacctttatgaaaggtctaccacattaagattcttcgagcacttattcaggcactgtatgagctaagcactgtacatgttatctcattcaattctcataagaactctacaaggttgatactaatattatacccattacatagatgcaaaaattctaagcgacagagactggcattttgattttaaagcccttttaattaccagatctgtggactccaaatgttcttgattgtatagttctctcagtacaaatattttgaacatgtacttatatgtatgtgtatgtttgcttataaattacatacaagtactactgtcatctatatattaaatattaataaacttgaacttcattcttatctttttagataaaaattataaatatcaactaaagtttcagtgcattttttcatcctttatatgaatgtcttgtagcctcactttggagaccatgcatcaagcggctccttatgcccaagatatttcatgattcccatgtatagcgttaagtgaaacactgtttaattgaaatcctacttgtcattgagttcagttccagttccagttaatattgcttgctttcaatgcagacttttaagggtggggactcttcctttttggatatttgattaggacttgcggaggagcgtgagagcaaggctttaattaaatttagagaggctcttttgatttatgagagtcaggactcatggtttcatgtgtccagtgaatactcagatcacttaacacagggcccaattgctcatcactttctggagctgtgtcaataaaacaagataacgtggaggaatgcttctcaaagttctcagttggcagtgtgtgtctctgttatctgcagagattacgaaatgcagactctgggtttccatggctggagagactgattttacagatttgaggctgggtatgggaatctgcatttttactaggctcgcttggtgacattgaccacaattatagggccataaaatctgaattcatatctgccacttaggtggatgaccttagataagtaatctattcttgaacttgttgaatttcttcaactataaaatggaaaaggtggctgggcacagtggctcacacctgtaatcccagcactttgggaggctgaagcaggtggatcacttgaggtgaggagttcgacactagcctgaccaacatggtaaaaccccatctttactaaaaaaacaaaaaattagctgggtgtggtggtgggcgcctgtaatctcagctactcgggaggctgaggcaggagaattgcttgaacctgggaggtggaggttgcagtgagccaagatcgtgccactgcactccagcctgggcaacaagagtgaaactccatctcaaaaaaaaaaaaaaaaaaaggaaaaggtaataaagctcaagaccaccttgcaaaatattttgcaaattaaatttgtgataattttgtcaaagtgctttataaaatgtaatacattaatatgtgacccattccctaaaatgttgtcaatctattaaaagatgtattctccatactaaggtattcggtatattgtaaattacttttaatttcaatgaaaacgtgattctgagcttctctgccctattcatttgggtcccaaggaaagagactatggtttatatttcctttcttctctgcatgaatggaggtagaagacagtagggatttataacagactttaagttcaggcaaacatgggctctgaccccagcttctacattatcttgcagtgattacttaacttccacctgtttatttattaagtagtgatcctaatgaattcttcctttcaaaatttttatcatgattttatcatgattaaatgagatatagccaaaatttattgcatacttgctgcgtgccagacattattcaaagtgcttgtcagtttactcacgaaaatcctataattttgagtggaggtcctatgagggatcccattttaaagatgagaaaatcaagaaaaagagatttaaatggtggcactaggattcaaatctctgctgtctgacaccttaaccatcctctttctacttcgtaacactacctctaaaaagtgaaagctttcaagtcacttagcacaccagtgggcacacagcacatcttcaaaatatgtgacattattattgttgttgttaatattattatttgatttccccacagcttcatgcagaatgctttgtgcaaggtagttgtttaacaaatttatggtaattcgatttttaaagaaccctgttgtatcctcttgggcttctgagagatacatattcaatgagcgaagcctcttactttttaggctaatatgatttatgcagctgcttttagattaagttaccatcttttatttacaaaaaaagattaaataaatatgtgaaaatccaagaactccaaaatctccctgtgaaaatccaagaattccaaaatttcccttgctaaaaactgtttagaaaatcatctttgtaagacaagaaggagacaaagaccaaacctacttttgattggtgtacctgaaagtgatggggagaatagaaccaagttggaaagcactcttcaggatattatccaggagaacttccccaaactagaaagacaggccaacattcaaattcaggaaatacagggaacaccacaaagatactccttgagaagagcaaccacaagacacataatcgtcagattcgccaaggttgaaatgaaggaaaaaatattaaatgcagccagagagaaaggtcaggttacccacaaagggaagcccatcagactaacagcagatctctctgaagaaaccctacaagccagaagagagtgggggccgatattcaacattcttatagaaaagaattttcaacccagagtttcatatccagccaaactaagcttcataagtgaaggagaaataaaatcctttacagacaagcggaggctgagagattttgtcaccaccaggcctgcgttacaagagctcctgaaggaagcactaaatatggaaaggaaaaatcggtaccagccactgcaaaaacataccaaattgtaaagaccatcaacactatgaagaaactgcatcaacaaatgggcaaaataaccagctagcatcataatgacaggatcaaattcacacataacaatattaaccttaaatataaacaggctaaatgccccaattaaaagacacaggcaaattggatagagtcaagaccctttggtgtgctgtgttcaggagacccatctcatgtgcaaagacacacataggctcaaaataaagggatggaggaagatttaccaaacaaatggaaagccaaaaaaaagcaagggttgcaatcctagtctctgataaagcagactttaaaccaacaaagattaaaaaaaagacaaaggcattacataatggtaaagggatcaatgcaacaagaagagctaactatcctaaatatatatgcacccaatacaggtgtgccaaggttcataaagcaagttcttagagacctacaaagagacttagactcccacacaacaatagtgggagactttaacaccccactgtcaatattagacagatcaatgagacagaaaattaacaaggatattcaggacttgaactcagctgtggaccaaacggacctaatagacatctacagaactctccactccaaatcaacagaatatacattcttttcagcaccacatcatgcttattctaacatacatccacaacacacttattccacataatttagaagtaaaatactcctcagcaaatgcaaaagaacggaaatcataacaaactgtctctcagaccacagtgcaatcaaattagaactcaggattaagaaactcactcaaaaccgcacaactacatggaaactgaacaagctgttcctgaatgactactgggtaaataacgaaattaaggcagaaataaataaattctttgaaaccaatgagaacaaagacacaacataccagaatctctgagacacagctaaagcagtgtttagagggaaatttatagcactaaatgcccacaggagaaagtgtgaaagatctaaaatcgacaccctaacatcacaaataaaagtactagagaagtaagagcaaacaaattcaaaagctagcagaagacaagaattaactaacatcagagcagaactgaaggagatagagtcatgaaaaactcttcaaaaaatcaatgaattcaggagctggatttttgaagagattaacaaaatagatagaccactagccagactaataaagaagaaaagagagaagaatcaaatagatacaataaaaaacgataaaggggatatcaccactgatcccatagaaataaaaactaccacagggccaatttctaaaataactggatttcactaaatggtgcatttagtgtttttcaaaatctgtatttagaactttgtcttggttctcttttatttttattttctgatagctctacattcattactgtacagtacctgatacgtttctgctcaatgctttgcagcttgttttttctcttttcaggatcaacttgttcatttgcttataaaatgatgagctttacctgaggaatgccagagaggcagattggactctctggggcaaaataatcttaagttaaaaaaaaattgaggtgttttcatgtcctatttcttttgcctttatttaagctatctaaacagtggaataagactattctataataacatcttcaaactctaagctccaaggtaatatgaacaaaagtgacaacaattcccctcaagcataactgaaacttatctttctatcccgctctcagacagtggaattctttaggctatagtctaaggaaagctaaccaagatagcctaattaataggctgaagtcctctgaatttagcctttgctagataattggagaaaatatgtcagggagtcaaaatccttgccttagttaaccatctgcctgcaagcattttggccttcttatcagggtggtaaatgacaggtatgtcagtacagcagaaagcctagcctttagaaggagctgcagctagactcccctcagtcctgacgaagagcagccctgtgagtgacctcagtgttcaccccaatactagctgaccttaccacaggcagtctttaataagtctctgttttaatcttctgttagtctggtttcagtcactaagtaggaggaacagctatttcaatgagtaggagagcttggctttgggtactcaccgagtcttcagactccagcatgattaaggactctgagacatacctagggcaatgagcttggccaatacattcattctagtaataaaagctgatttttttgcacaagtttaaaaaaaacagtgatccagtggaacaaaaattgccatcatgatatttacaacagaaatgaatgtatttgttaaggcaaactggtgttgcaaacatccccaaattgtagtggttctacataataaaggtttatcacctgattcacagtctagtatgggaagtgggagtggagctgtgttccacacagtcatttagggactcagacactttttgtctggttgctgcaccatctcctgggtcattggtgtcctgcctgagcccctgcattcagcctgcagacaatggaaggtcatatggaggaccttgtgcaggatttttatggactggatgtagaaatagttatatcacttttactcatactctttaaacaggactcagtctcacaaccccctaaaattacaagagtgtttgggaagtactgtcttgctcatgtagcccaggaataaaaccaaatgggctttggtgaacaaacagcagactagccacagtggtcttgaaaaattctatatattgtggttctatttactgatggagcttagttgtcttttttcctataatatatatatttttggtatgataagaagcatagacagtcctattgctctctagaagattgtattccacttttttccctcttttagatttctgatcttgggttctattcttttcttctttagtggtgattaggtttagatgatctctgtcagcccgagtacaaactatgggtctcctccccatctgcctccccagggtagatgtgagaagtgctactgtgttgtattccacatcttgccactattcagcctgctgtctttttattctgaccctttgtgaagtcaaaaggcaaggttttctgcagattgaactagacctgagtggagaagggggtgaactttcagattcaatgaattataacacttctaatatagaacctcatcaccagatttgtgatgacaacactagctgtgtatttgactttactttttactttctaattccttggatttgagtaacctaaccatttcctcagtattatcagaaaaaaaaaaacaacacattacttttcctcccacatttaattgaatcaaaatcaactgtattaagcagttacagagtcatttattaagataggtggggatatacaaaagaataagccacctcctgcttcttcaagaaactgagagtaaggtgggaaacagacttttagcatataagcattctgctgtgtttatgtaatagctataaaacagtttataaatatgacaataagggtgcaaaccagaatatgatgggaacataaagagacatttattttgtccagttgtaaatggtttcttaaaagagaaaacatttgaaatagaaattgaaaaatgggaaagacctcgctaggcagaaaaggagagggaatagaaagcctgggtagagggtaccgtgcaaaggacgtcatggtgcctttagagaacagcaaggtcatgggtgtggccaaatcagaggatgtgaagggagaaagtgtaggaggatatgagagttgggaggataagttggaacaacatttatgaagggtctaaacaccttaatttggaattagtgttttacaatgtaagatatgaagaacaacaaacatgactttaatagagaagcagtaagatcagactcacattttataaaaataagtctagcaacagaattgacaatagattagagaattttaaactcttatattgagtttgtacatataggggtattacctttttgtctttcaaagacttgcttttgagcatagaattgatacaattgatattaccattgcccttttctcccacacgctttttttcaagtgccacaaatatagctctgaaataataggagatcatattttaattgaaagtgtggtatgtagttccattgttctataatgaaagactaacatgtatcagatgaccttcataccaatagtaactaggaattcttgacaaaatataagcaacaacagaaattgtttattggcactagcaagtaacttaaaataggctgaaataagagagattctatttgtgacataaggaaccacactgagtgagagccacatttaagagatcatgtgacttggaccctgagggtcctacttaactcatatggtaagtggctgagagggctgaaatagaaagcaatagttattcacatgggaaaccacaggactgaattcaggattgtcagaataggaattaaggaggagatgccagaaaggagagagtcacagatgaaggagcccaaaatctacaaataaatccctcttgaatccttggttgagtctatgcatatgcagagaaagactctaagaagcctaggaagaaaatgaaagctagaaggtgtaaataactgagaaaataattcagcagcttcttaactgtatgtctatagaatttggaattttagttctccccaagttagagggggcttggctaacatcttgggttttccgctgaaactccagaagggctatgcggtaggagtaaagactacatcctggcattaagggatttatcatagaacttaagaaaaaattgaaatagacccaccttaacgaaacgtccatattacttggcagtattttacctgcctgctagaacaaacttctaagataatagaatcttctaagataatagaagataatagaatctaaagcctctaccatatattatacacaagtttcaatatgccatcagtaatttactagacatgcaaagaaataagaaaatgtattccagagtcaaatgaaaaatgagtcaatacagacagacccatagctgacctagataatggaattggcacatagggacattaaaataactatgtcacatctgttaaggaatttacatgactagataaaatagaatggatgaggagatgggaaatttcaggagtcataggaaaacagtaagaagaagaaccaaatggaaatttcaagaatgaaaaaaatgaaatatttgaaactttaaaaagtgaaatggaattaataacagatttatcacaactcagtaataaaaagacaacaaaaattagcaaaagacatgagcagatacttccaaaaataagatatatgaatggccagtatacatttggcaagacatctagcattattaattatcagggaaatgtgcattgaatactcctttatagtcattagaattaccaacattaaaaaggctgacgacaacaagggactgccaaaatttgaactctcttacattgctggggttatgtgtaacatggtaatcactggggaaaactgttatgttagttctttataaaataaatatgtacttacctagtaatttcactcaatgatatttgtccaatggaaatgaaaacgtatagctacaagatggtttatacaagtatgcagattgattcataatagctaaaaactagaaacagtctaatgtctattcacagatgaatggataaagaaattacagcatattcaacaatggagtattacaaataaaaaggaagaagtctaaatatatacaacacaggtgaatctcagaaatatttaatatgtggagtaaaagaaggcagtctctctatctttatataaagtttgaagttatatagcaggtaaaacagttctggtgatcaaagtcagaacaggaactccctctgggtgaggggaggggaaattgaatggaaagggcacaaggtagctttttgggttcagggaaaggttttgtatctttattagcatcatggttacataaatgcacacagttgttaaaagttgtcaaaactgcacacttaaaatctgtacatttgattgtgtgtacattataagtcataaatagaatggatgggaatttaaaagtaatgtaatagagtgcttcgatatgccacatgcaggaattgagaagacagtgattaataatggttaagagcatggttgcaatatcagataaatctggggttttgaatcacgtcgtgagtactttgtgaatgtaagcaagttactaacctaagatcctaggaaatggagatgataaaattaatatttaccttataaggttgtccttagtgcagtgcccagcacattgatgcatttggtacatttaagctgtagttattattattaaatagctcttcagctagactttcactgcccgagtgcagtcaggaatactgggataaccatgaaaattttgagaattagatatctgcaaactgcattaaggagcaatctaaataatgcaggtaatatttgacagcatatgattaagtatactaggaaatcctattttcattatctatttgaaagcaactaattacctctttgccaagaaaacgtttactttaaaatacttttcttaaagctcttgtaaaaaattttcatatatagagaaattaggacttaatttttcccttatacagtaatctcaccctctgtttcccatctcataataatatcaccaactgctgcatatattttcagtacatatatatatgtgtgtgtgctgaatatatatatacacattacatatatatattacattacatatatatatccatatatatgtatattcagtacatatatatatgtacgtgtgtgtatataatgttgtaaacaaaatggtaaccatactatatgtacttttctaaacctggcattttcactgagaaatcttttcatttgaaggactctgtttacctatagctggtctattcattttaagtggtgtattacagtctatggcattgatgggcttttatttatttaaccagctcctgttgatggacatctgagtagatccaagttttcactattgtaaacaactgtgacatccttgtatacgtattttttgcacttgtgttaataatttcatgtaataaatttaaaaagtaaaaatgctaattgaaagaattttaacaaaatatattaatgtttctttgtaagagaaaaaactttatttttatttatttattttttttgagacggagtttcactcttgttgcccaggctggagtgcaatggcacgatcttggctcactgcaacctccgcctcctaggttcaagcaattctcctgcctcagcctcctgagtagccaggattacaggcatgcaccaccacacccggctaattttgtatttttagtagagacggggtttctccatgttggtcaggctggtctcgaacatctgacctcaggtgatccgcccgcctcagcctcctaaagtgctgggattacaggcatgagccactgtgcccggcctttatttcttctttttaaataaagaagaattatttcaaaatttacacaaaatttgatttagagtacttaagataactaccaccaaagggacacataacactgtactagacactatgctgaatgccttccatgcacaaaattattcaaattttatgcacaactttgtaactgtgtgagatactaccattattgacaaggacttgtaagaaaaccagtgcttggagcatgccatatctggtaaatgtttaagtctggatttcaacctagattttgcaaaacatgcagtgtagcgtagtctggagtgaatttatttttttgtgagtgtctttgaggttgaggatcattgtcaaactttggtgatatgcaagtggtgaagtaataaagcccagataatgttgtttccctggaacacttgtgaggccaaaagtgatgcctccctgccatgcagtggcagcagaagtcaacctggacattagacaagttatacttcccttagtgccaatagcctgtcccatatccagcttcgtcttaaataataataatgataatgataataaagatcaaggatcaattacatggtgttatggactgtggagaggagaagtcttcagacctctaatattctatctattttcacattccagttactactactctctcttttcctttattttataatcttgctttttttttctatccaaggggcccattcaataataactaaagccccaaatcctcaatttcctaatttatgtgtctgtgatcttttagtcttctacccttctacctgtgcactcacacacagagaactttaatttccagcgacatcaaatttgtgctctcaaaaggtaatttgtgatgcctggatgtcaaaggcgcccagatgtaaagctagagagctgatgagacctgaggctggtcacgggcacaaagcctgcccttctggcagagtcggagcagcactgaagttctgcttcaggccgtgccaagtgagagtaaggggtggtcttatgggtgttaagcaagacctaatctacccttgcgcagcacccagtcagacaccctgcagaaacacaatcatgtgtgtgtcattctgttgtggggagaagttgctcaaaggtttggttttgattttggtagctttaattctactccttcagttttgaggtgagcacaaatgtttcagagtacctttctaggtttcttactgacttttttcttctctaacctgtggtgtgttagaggcaacatgtaccagctcgggaaagagagacaattgtgagcatttcttctcaaccctgtgttcagtgacatcaagttaatagcttaaaattggatatggggaaaggaattataccactgaaatggaaaaatgctacatatcaaggattctcccaccccagagaacctgttgtttaactagcacacaacttctataacccttctacttctgttcaccacataacctcaccccccccccccggcccccgccaacacacacacaaacaagctagtgtttgaaacattggacaccctgggttttcttccacgggctatggttatttacaggaagaacaaattgagttctcttcctcttcccatcttgagctttatatttatttccaaatgccaaatataagctaactttcttctttctcccttagtggatggctgtattcatagagcagccggcccctgtttgctagctgaatgtcgtaacctgaatggctgtgatactggacatgcaaaaatcacatgtggctatgaccttcctgcaaaatgtgagtacaactgaatactgtttcaaaaccagatgagacatcttaacttgttttactccagtgtataactggaaaaggaaatggcagtggtggtatttaattaaatgtgcttgagttcagattttgtacatggtaataaaaacgtgctttccaagtatgtctccaaatatatacatatatataaaatatacatatactgtgtatattatatatatatatgtatatacacacatatgatgtttaactattcaggtctttgacagagtgtctctgaaagggaaataaaaacatgagcaaaatatacattatagcatttaagtgccacagagtgacagctcctggaaatgatgccaatttcttattccttgttcaggtttcttgattgtggatgtgtttagagcaaaggagatcaaagtgatgtattgtttttccagctgccatgtaaaggctgattggcaattacagccaaggcatctgtcacactttgctttcaggaaaagccaacgaaatctggttgtcagtgtgagaatgtgtttgctctttgaatgcggaatggtcaaaatttccgttatattttaatagagagaagtattgcatttgattgaccttattgcttagtgattcaaccaactgggtggcatggtatgggataaaatacttagagagaagctggtcagtgtcatagcttttttatcctgtaatcttcagggcctgaggttggaggtagagggtttcattgcatcattaaggtgtgtattgacctggaaattgagacaccaatttgttgattatcacattcgtccacttcttatgatactgctgagatctgtggaatacattttatgtaaaagtgaagctggttttgatttttgttttagcagtggagaaaatatgaatgaaaatttataatacaacctataggatactatgggttatatatagacaggttgtcataacagtgaatttcttgtggatgtgtgtgaatggagaatagcgtgttatattttaaagattactgtaaaggtatgtttaaatttgaggacttgtagcaaatagtaatatattaaaacagtatttttctttatcaatataatattgcatcctatattgttcataatggtttcagtgaaagtactttcatgtactgcatagcgatgctttggtcaatgatggaacacatatatggcggtggtcctataagattataatacagattgagtattccttacccaaaatgcttgagaccagacatgatttggatttcagatctttttttcagattttgaaatatttgcatatacaaaatgaagtaatttggagatggggcccaagtctaagcacaaaattcatttatgttttatatgcaccttatacacataacatgagtgtgatattatacaatattttaaataattttgtgcatgaaacaaagttttgattgtgttttgactggcctgtcacatgagataaagtgtggaattttccacttgtggcatcatgttggcacacaaagttttagattttggagcattttgaatttcaaaacttggattagggattcaacctgtactatatttttactgtacgttttctatgtttagctatgtttacatacttaccattgtgttacaattatttgcagtattcagtacagtaacatgctgtacaggtttgtagcctgggagcaataggctatagcctatagtctaggtgtgtagtaggctataccatctcggtttgtgtaagtataccctatgattacataacgatgaaatcacctaaggagtcacttctcagaccatattcctgatggtaagtgaagcatgattgtatatcaactatatatgctgtttaatttttcctttaatgatttttcatttatttttctttgttagtatctttacctagtgtgaaatagtcaaatcatgtgccaaatggctcttcactactacttggaatatgtacttgtgtcaaacaaaccctttgtgtagaatggtgtttagagcagttctctttgtaactcagaggtcatgatctgggtattaacggtgatttctctctccagaatcatatagtgctatttttacaaatattggttcttttgctttctaataccattctaccttcataatttacctaacttacactgccctgagaacaagcaaggttgttgactgctacaataatagcaagattattgactgttttcagacttgtatctgtccttaaaccaagtaatattcccagtcccctattgattcactgttttcttttttatgtattaaaatacaaatcaaatttctccaaatctgaactttctaaagaacagtatactcagaatcattaaatacgcccaaataaaatggtggctgtagtgtatgggttcacactgtgataattttttaaatgtgcttgtatctgtttgacatccctttgaataagttattcagtttcctttgaatacaattcatcttattttagggttattgaagacttgcacaataccaggcactgaggaacaaagatcagtgagtcaataccagtgcttgaagaattccaatgcttgagtcataacttcgaactgaagtgtggctttcatgggcatcctggggcaaatggatcttttgggacaatgaagctagaaatgaccagtcaatcaatgggactagctacagaatccatgagagctgagatcctgagagccgacagatactcaagtcactgcatgcagcccacagggcatgtttagtaaaaactcatccaatagaatagaaattaccagacaggcattgcagtgccacctcataaaagtcataaacatggaatatttgtgactaggtcttgcttcttcctatatatttaaaaggttaatgatttatattaaaagcataaaggaaagcaaggaaagcaatatgaaaatggtaataatagcttacatttttatgccactttataatatttcacagtactttcacaagcccttatatttaaaattatgtttgataaacattgtgtgtgttcattttccctttccctatccctgagagatgtttttctttctcatcaatttggttcatccatttcagagtcattaacaatccacagatgtgcttttgtagtgagaatgaaaagggagctcgttacatactgtttgggtcatttttcctctccatatttaataattccatgacagtttgacagcagagactagttgctatctgtcctctgagacagcgggtttatcattataggggtactaaagccagtcatccagccacaagtgataatatcttcatgcatcagcaatttgtttggaaaatgctattgtctgggttacagacaaacttcatagttttgaactggtttttgcctcttttatgcttgctaaattaatctattcataaatggttgtatttgaattaattatacttgtattctgtgttctgtgactcatcataattagtagaatgataagccccagatatttagtttacttttcactgcttggatgttttgaatgatttctttttgacattaagaatatccaatcattcttttcaaaagaaatcttaagggtagaaagaatattggtcaatatttcattgaaggctattgctaaggaaatgacttagaaagtagatggaggattgtttatgtaattggatcttttgggaatcttctctacaatattagatatttttgaattcataatgcaatttaaatttttatagatttttagaagcttgttgacatatgggacatttctattcatgctatcatcattccgccaagtagtcagcttcacataggcaagatttgtctatctcagtcagttccaatgtcagtatcaatcatagtgtctcctaaatatgtgctgaattaatgtgaataaatgaaggatcagacgagtgaattatttcaagacttcttcacctgaaaaatagtttttaaaaacacttttgcctctacttctaatacttttccttccgcaattattctgcacatttctagtaaattaacattcttaaatccagagtccttaaaattgtctacaatgctctacatgatgtgacctttacttctctacatcatctccttctgtgcttcccccactcacacaggctgctttgtgtgaacctggtcctcaaagcctttgcactggcattccttctgctggatttctattcttctagatacctacatggcttgttccttacctacctcaaactcttgttcaaatgtaacatcaggtgtcaccctaaccaacctatttataattgcttcagtttttaaatttgtaattgcttacttgtaaagttaatcttcaaatagcattatatcatttacttatttcttttgtttcttatctgtttctatctaccagaatatgggcacagattcttctttcttcatttttctaatgtattgctatattcatatagcttaaaaaatgtgtgatatataataggggttcaaaagatatttgatgaatgaatgaataaaacgtaactctaatcctctcaaaatccgatagtggatttttccttaaacacagactcattagcctgattacctttggccttccactgaactacttacaaccttttgtatgatatgaattgctcacaatggtgtgtctatgcatggggtctgtatctgagctatctagaaagctctttctttgctcctttcacttgtcttccagactcagttcaaatatcacttctgccatgaaacaagtcttctcgcctcacctcagctaaaaatgccttcttttttcttcacactccagaatacttcatgttaacatactgagggcacttgtcacgtgctaccttttattgttggatatgcaaacttcccacttttataacagagtaccttgtatatcacaggtactagagaaatatctaacaaatgaattagttattgaaagtgtcaaacctggttgataattggtagtaggtggaatataaaggaaaaattatgctaatattcataagaaattatgaaatcagtgtcaattatccattgtgtttttaaaaaacatattttaacatatatatactacaaagtctcctgtctccaaaatttactcttaatggagtttctcctaaggagaaaaaaaaataaaaataaagaaaccatatcacccttatttgatggttttcagcatagctcacatgtctattttatttctttagaatgcttctctcttaggcttcagggctgaatagtcatcaaggataaatggaaaaatattaaacttgtgtaaatgaaatggtggaatctgtttcttttatttcttctatttaatctttggaaggcatcaaggggtaatattgactaactcaaggttttcattaatcatttgaagggaaactctaaggtgagagaccatagcataatatgtttgaatgagtggtatgaatcagaatacacattctattcccaggtgcaataataatcagatgatagtagcttaaaatgtactgttgataataattagtacttcttttctgccctttatcaagaaatcatagtactttgaaacagtagctcatcagtccttttgaaattcctatgaggaggtgacgtgacaagtaaagttttcttacaacacaaagagaaatacaggtacagggaaaataaatctgttgctcccattaacaaactaaatccatattagaggcatcgtggtggccaaggatccctgagctgggaaaggagtctctgttaggtgttagccaggcctgctgcctgtttttatagataaagctttattagaacacagttgtggccatttgtttacatattgtctatggctgctttcatgtggcagagttgagttgtagctacagggattttacggccacagaacctgaagtgttcactatccagcctctgtggaaaaagtttgccagcccctggtctgtggcaatctgcacttttatttttatttttttctccctgagtcagacggattccagctctgtcgcccaggctggagtgcaatggcgcgatcttggctcactgcaacctccgcctcctgggctcaagcgattctcctgcctcatcctcccgagtagctgggattacaggcatgcgccacaacacccagctaatttttgtatgtttactagagctggggtttcgccatgttggccaggctggtctcaaactcctgacctcaggtgatccactggcctcagcctcccaaagtgtgggattacaggtgtgaaccacagcacctggccaatcttccctttttataaagtaagaaaggtgagattcagagagactaaatattgaattttattaaatgaattactacttattcagatcaaagttgataaagttgagactaaaatacctaccctctattccttgggacatccttgcttctgttgcctcaagagaacattaccttgggaagatgatctgaaacctttcaaatctttcaaataataaggccaccttgaaaagaatgcctagaaaaatatggtgatttttcccaatagggccagatctgggaagtgagtaagtcgagtctctcaagggagagtcagtttaaaccaccagagtattaggaagcaaatctttgttccttgtttcctccagtggtgttagctgcaaaggagcctgcagtccacaggaaatgcagtttctagagcaggtaattcataagatggttctgagttagtcctttgcaaagggtgacctgatttcagccatcgtggactctcccagcaggtgtctgattgtgaaagcagtggagtggacatgctgctaggagtatgactctgccagcctttgatgaagacctgagggccctcatgagccccttccataatcaaatgacttatattacacaaagagaaaagccgcttttgaagatcataaaatcatcttcctttctgaagaggaagatgggattgttcctcctaaaatcaactcggattggctcattttctttaagtgcttaaggaattcaggttttatttgaatctatttctccataattgtcacccttttcatttacattaagcagtttcatacatttaatctccttagtgatcctcatgatgaatgtggaaataagaagggcagaaatattctaaaaaccagagcagtggttctcaaaacgtggttcctggagcagcagcatcacctgggaatttgtttgatacaaattctcaggccccaccccacacctactgattcagaaaccctgtggtttaacaagttctccaagtaactctattgcgtgctcaagtgtgagggccattgccctagagagtggtggaatccagtagcacccttgccttgagatttcttttggctttacaacacaggtatccatttgggtcacagattagggctttttttgaagagaactctgacacgttcttcttttcctttatagcattttccactagtgatgacatctgtgtttgtttatttgtttattacctgtctttttagacaaaataacattttaagaagggaaggtgtcctatgggtctcatttacccctgatatccttagcatctgacatagtacccagaacagagttggctcttgatacatatttactggaggacttaatgaaagcattgtttttatctcctcttgtctttgtcataatcatagctgccctgcaggaaaccgagcaagaagacactcaagagagaacaacatgattccaggaatctgcagagctagtactcctgctgcttttagcatctctgttatcccatcaccaaacatactgcctgctcaaaggctagcagtataagaaagcacaggggccaaactttgcttaatgtatccacatgccacatgtctgttctatgcttagcttctttcattttctcttattttgacccattgtgataacatagagtccacccccaaatggctttgtgatgaaataacttaatgattctaatactaaatgttgtcttttaaaaaatatctaccttttggaagcaactggtgtttacactgttgtattactggctgagtgtagaattaaacagctgtgttttgcattatttgccatcatagcaagcctttagaggacgctgtctatacctcctatttcctatgtgatcaataggaaataacagtgtaaatcaattctaggtaataatgtaaatgggctcttgaaggcaattcctgctgtgaaataagtagttagcagtgacactggcattaaccacagtgggggtaatcagcctttggatgtgtttaatcagagttatcagctaagattaaaaagagagccactgttgtacagggataatcattttcaggatttaaaagatgaatatttggaggtgttctcataaattaaagccatcagaatggctttgagtaatttaggatgccctgaggtcaggcacaagcaaacaggaaaggttaatctcagagctacggtagctgatgtgcagagatggcagaatacatttattgaaataagtagcaaatgctgagtaaaagtgtagattttttttctccctgtgttaagatgttccttgagctattacttacatatatgatttgattaaaaagtagtccacagtgaacacttcgtgaatgtattaactctccctgtaattaatcactaatcccaaagattaaatattaggccatgttatgacttgattagaggtgtttctacttgaaaatattgatgtaaccaagctctgtattatagaatgtaagattgattctgtgtcaagaacactaaatgtcatggtagaagatctgagatgcataaatgcagagtgttgtaattggtaaagtccttaacttctgagcctgaggttccttatacgtgattgtctaggagtgtgaagatctcactctggagagtctgttaagccatatacgcagaaccgcttcttaatactgtcagataagagagataaatggctctattattatttgtaaaatacatggcacacttgatttgcttgttcagcccatgttttattgagtacttactcacagctagagtgctcttctagagtgtagacgactatagtgaggaagacagcaggccccttgtcctctaagagcttaggtcctagcagagagaggatgctaatgaacaagtcacataaaagcaaagaacctcagataatggtaagggctatgagagaaaaaagatccccttaccagatgtatacagtaaggatagttcatacatttttgaaatgttctcccttgctacaaatattctatttcagttcttacatatttgtaactttagtctaatttttggagataacaaagggaatgctgcttctgatagagctgacaggaattttaattattacctatttgatctcagaattttacagataaagtaaccgaggcctaggaaaattacttaatttttcccaggtcatgtggtaagagacagtgctaagactatagcctgacttttagtatagtgatctttctgctgaaggtactgcctctcttagtctctttgatcataccaaccctcttatagaagtatggtgagaatttaataactgttaagtgagatgatgaacatgaatgtatttttaaaataaaagtttcttatctcatatggtaccttattatttagtagtaatttgtagtaatattgcaagtaattttagatgagttacatataaattaattatggtcccatgagctttgccaataaactttatgacaataatccatcagtatatgtgcaacagtgactggtgtttgagaaaatatggaagtcccagatagggattaataaatattcaatactagcctcaagactcagacatttgctcatgtctctttccagtatcttgacctcagagaaaaggggtactttaaaagttattttgagaaacttcagatgacagctttattggttttaaagatatgtccacagattctttgatatttctcttctggagagctagagcttaattcccctctacttaaacatggcctggacctaatgactcccttctagcaaacggagtatgtcagaataatgggaacatctgaaactagtttaaagaaaagactgtggtttccctctctctctctctctctttcaattcactctgtattagcttcctagggctgctgtaacaaattaccacaacttgatggccaaaaaaagcagaaatttattctctctcagttctggaggccagagagccaaaatcaaggtgtcagcaggaccatgccccattctgaaggttccaggagcagatccatccttgcctcttccagcttccattggcctcaggtgtttcttggcttgtggcaacataactgcaatctctgcttctgtttatacctgacatcctccctgtttctctctgtctttaccccttctcttctcttataaggacacttgtcactggatttagcactcactcgaatccgggatcatctcaaggtctcaagatccttaacttaattgcatttacgtagatccttttccaaacaagttcacattcataagttccaggtatcaggacacaggcataactatctggagtcaccatttaattcactacatactctctctgagcatggccagtttctatgtcatgaggcagtctagaggaggggaaaaccagctaccatgttgtgagggaactcagacaccttctggagaggcttgtatgctgaagaactaaggcctgcctgcagcaatgtgagtgcgcttgcaagcagatcttctgaagccagcccacagccacatcagtgagcttgggagcacattctcctgcccaatcaagctttccgatgtctgcagccctggctgacagcttgactccaacatcatgaaagaccctgagccagaggcatccagccaagccactccaaaattcctggcctgcagaaactgtgagataatacatatatgtttttttaagtgcagggtaatttgttacgtagcaataggtagctaatgcagcaactatgatcctgaagtttataaagcaggggaaagggctcactatcagagtgggggatatcaatcacattttctcagtgcagaacctgcctgtgtcagagacaggcctaaattggaaaatgaaagccaaatcacatggtgggtaatgttacattatacaaccaaagccctttgccataccattatcataggcagcatattacattggaaaaactattatgaacgaaaacttcttagatagatagatagatcgatagatagatagatagtcaaagagaacccaaagtccagcttagtaaagaagcattgagagaaaaacaacacaaaccaaaacacacaactggatattaatatctacctactcctgttactccttgaccatgctctagtctttacctttgccactcacatgcttttttttactgataagaattactgtttctattttggggggaaaattaattcagtttctgtcctctgttaatgctgtgagctaagtgaagcagaggtaacttctcatccgcatatgttgtgatgcccttctaaatgtgtttgctgtataagctggtgtgtttcccattagctgttttatttttcagaactaccgagagtttgcttcatttttaatcacgtgctatttgtgaaatccctgtaatttcctaaggccttctggagcttgcctcttcctacctgtgacattttcaggaaagatttattctctctgtgtgtttattctgcttagtgaagatcatgagacacagccttaactggagttttgcaagttctttttaaaattgtgtctgtattgtgtttggagtctagttacccatttggaggtctgtggagggcaaagggctctcttgggaatccctttcttttactgatgctcagtgtctgctttctgatattatggcatgtgatgacaaactattgtccttccgtactgggctggttgagtttgttcttgcttttatgttactcctatacttagtacagtatattaaatacatatacatgtcatctctcatgaccttcattctcatgtagaacatatatttccttctgagttataatatgttttgtgaatatggaattcagggattgtgttcagtttgtggagctgtttgggaaagcagtctgagagagtgggtttgggagtggcttgacggaactgggatgaagggcactggggattccccaggaaatccgttggctggcagagaagagctaactgctgtgctggctaagctcatggaactgggctttcctccatatgtccgggatatgtcctacctattgttttaaaattaacaaaagttattttgattttcttcctcctaataatacctattgcctgagaagaacgatgccagattgagaaaccccacatcaaaatatatccaacaaaatggtcagagctttgtacatagaatattccatagttagaatgatccatacagctatgcacaaagagggagccgaaacagggaactgcacatcaagagttaatacagtacttttagcctttccttaaattctctgtgttgtgcaatggcaggatttctccatataccaaattaactgattgccgtgggcactaaacctgttaccttaaacacattcatatcacactacaagtaatatcttatcctttatacttattttgagattaactgtctatcacacagccctctttcctcccatattctcattttttttcttatcactccattcagaaataagggatcgatattttaaaggctgaatgtgagatgtttctatttattgttcatcatggtaattagcaactttttaattatcactgttcttgaggatgtatgtttgggaacagtggagctttcggtagagtcacaatgacagcagtttaaagctggaaagaaatctggaaattgcttttctggcaactgacaccagtttctaggcagtgcctaagaactaggcaaggatttttaccctgttgtttaagactgtacactttgcatctcacaatctatctgctacatagtaagcaaatggttcattcaggcagcaatcactgatttgctccctaatatgtgccaggtgctttgcttatttttttggaaaataatactgtgcaaaaacagacagggacctcaccctcatggaactgtgctgtgctgagctgaaatgaatcaagtgacctgcccaaggtcttcttgcacagatacttaagtgatggaatggggattttacttgggggcccttccttacaatgaaaagacctgatggttttggtcttcccgtctgggatgttctttccattaatagccacactgtctaaatggttaataacatggactttgaagcccaacattctaggctcaaactcaggctctggacgtgggcaagttgtttaacctctttgtgcctccgttttgctatcgggaaataggtatgacaatcaccctaccctcacagggaggctctcatgagttaatgtctgtgtggcactcagagcactgcttaactccaagtgaacactgaacatggttagctgtttttcagtaagatcaccccaactattttatctaaaatgtcacctcttcactctctatcttcttgccctgctttggttgacatcacagcccttataatcatctgaggttatttaatgtctttatttttttttttgctgaatgtttttcttttccactagaatataatcttatgaaagtgaggactgcattcactgttacatctccatattctaggaacatattcaaaaccacctgtgaatgagcaaatatgtgcacatagaaaactttattaatttaattaaataattaaatgtaattatttaattaaataattacatttaattattttaataaatttagtataatttaattatttataattattaacaaagttatcagaagaactagcctaagagtactttcagtttcatgctctgttcatttgattcctctagtaacttggctaatagatacaaataagccaggaaaatagcatcaacatatggtaaggtcaagctcatatttcatatttaatatacctaccaagcaagttttaggtgtgctgcacatctttttcatatttttaaaagtctataatttaagtaatagtgtccggatgaaataaagcaagaaggaagaggtttaaagaacttcagggacctgagagccatgttctgacctgcctaatgaaaagctcatgaattgatagtgaggtcctttcccccgatacagagtcagcgttcaaagtctatttctaagctcaatttattgttaaatctcattaaaataaagtgataattttatgggtttgaaatgtgttataactgacttttctgattgagactgctagcccaagtgcttacaacttgcttaaatgttgtaaatgtgttaaaagggggaatgttgatgtgtatttcctctgtgttcaaactgttcagattttatgggaaataataaagctttacaacttgttctttacaaatagaatgctagggactttgcagcaacatgagaaatctatttattattttgtgtcagagcaagctgggcatcttcctctttgtagactgccagagttcattgttatttgggacagagaaggaaatagcatgatagtcagggagataatattaattttacagaaatagaatcttattttattacaaggaaggccgtcagtctcacaacttgcactctatttgtgaagaaatattcttaagcatatattccagtaatatgtagtttaatacctatgtgaaaactaatttcttttcctcaagcatcaacttttatcacagaactttaaatctagaagtttaaagtttaaactttttaaatctagaagtttaaagtttaaactttttaaatctagaagtttaaagtttaaactttttaaatctagaagtttaaagtttaaactttttaaatccagaagtttaaagtttaaactttttaaatctagaagtttaaagtttaaactttttaaatctagaagtttaaagtttaaactttttaaatctagaagtttaaagtttaaagtttaaatctagaagtttaaagtttaaatctagaagtttaaagtttaaagtttaaatctagaagtttaaagtttaaatctagaaatttaaagtttaaatctagaagtttaaagtttaaattttaaatctagaagtttaaagtttaacttctccttatattaaaggagcagtatgaatattctttgagagatgaactttaaccatattttgtgtgtgtgtctctgtgtgtaatatatacctatagaccatagtctggggaaaactcatttttcacttcttcttttcatgcaagatcttaggtgctgtattttgcaacgtgccgtgtagcattacatttcatgatattataagctgagttttatagaactgtttcaaaaattttcattatggaccttttatatcataattgagtatctagcaaaaggtaaaaaaaagttccacttatgaagctgaatatcaatcactcaactattcagttatgcttaggcatagatgagtaagcttgttctttgacagttaagacatatggtggtgtgtgtgtgtgtgtgtgtgtgtgtgtgtgtgtgtaatagatgtgccagataactaaaatctttgcttagtactttgagggaaaaagagattcgtgatgagtgcatttattttattccattctatccacattttgtataaaatccatttaaacaggggaactaaattgcttacagtagtaaaatgcatttccctctgtgaatgttggtgcctttatgatgcatgctgatttggactctgacacagtcataatctacataccaaacataggcattttgctttcaaaacagaaactggcactgctagagctgtaggagtgagctggctcaccagagtaatctctccttcttggagagatttggcttattgttgatggcctgaagtccactgtcttggacctcagagtgggctttccagtttgtagtaatgggttctgtagcatgccaagactatagagacccccgaattcatctcttttatttcccttctatgagggaattcctgtggtcataaggcctgcagcttaacagatgagcagaaaatgtgctgaaacattggtgcttaaaaatatacaaaatataagtgggaatcagtgtctttagctttatctttgcaatgggcaaaacagaaatgactcaaaagtgatttctttagttatggagcactcaggtttctcttctgccttttgtatttccatatgtcactgctatctatattctgtagatactctacctgtgacattctgggattataaatatgtgagttgcatgcttattcactttctcccaccttttcattctatcctgagtagtctaaactgaaagcttttgaaagccttgcatgttttccacatcaacccttgaacatttatacttctaaaaaaggatgctggactctcttgataactctgtccttcaagtttgcctcatcggtgatgccacttgactgaaagtcctcttggtaatccagtaattaaatccttctagctgaggcccaagagagatccctctgctgaattgcactgcacagtaaatgacattataatgaggttttaacttattagttaaatgaatgaatggaaactttgctgctgcaattcattagatttttacgttataaaccaggacttgctgctgcagatgagagtccgtgcaattttcccttcgtataattaattatcatatcagtgtattaaagatagtttcactaaaaggagaaatacccttgtatagaaagtctaagacagtctaacaaaacatggtgatcacttctgtatgtccctgagcttggtgtgataggcactgttcagatacttctgcaatattatcaaattttaatcctcaaaacaaccctctgtgatagttactgttattattcctattatatatgaggaaaatcaggcacagagaggttaaacaactttcctaagatctcatagctagtaagggtagagcaaggattcaaactcaggcagtctctctctatagctctgcacttataaataagatttcctctcatccctagacatgaacatgaagatttgcttatatataaattcatcttattgatatgtttcttttgaatttcttcccctttttctaatgaaaactgatgatgctatttagaaagctttatttttttttacctaaaatgtttaatctcagaaaagtactgagaaaaataacagtactcatgcattacccaccaagaattttaaacatattaacattttgcctctttatttctactttttgtttttaaaataaaataaccagttatttctgacaaattcttcttttcagtctcattctttccttcccctctttccattccttgtccagagcaacccactcttaagagcagaatgtaaatccttccagactgtgttcttatatttctaccagaagcacggaaatagccataatccatatacatggtattgtgtttttaactgtacacaaatggcctcatggtgtatgggctgtactgtttcttggctttttcactaaacattacatatgtgtgtgtgtgtatatatatatacacatatatgtgtatatatatgtatatatatgtgtgtatatatatgtgtatatatatatacatatatatatgtatatatatatacacatatatatgtgtatatatatatacacatatatgtgtatatatatgtatatatatgtgtgtatatatatgtgtatatatatatatttttttttgagacggagtttttctcttgtcattcagggtggagtgcaatgtcatcatctcggctcactgcaacctctgcctcctgggttcaagcaattctcctgcctcagcctccctagtagctaggattataggtgcctgccaccacaccctgctaatttttgtatttttagtagagacgggatttcaccatgttggccaagctggtcttgagctcctgaccttacgtgatctgcccgccttggtctcccaaagtgctgagattacaggtgtgagccaccacagccaacctaaacattatatttttaaaacctctccatagtgatctatctagctataattcattctcagctgctatatttctttcttgcagatacaccatattttatttgtttattttcctctaaatgggtgattagttgtttccaatattttcctgttataaacaatactgagatgaacattttttgggtacataatgtctcacatactttgcctcctggatcgggattgctggttgggagggactgtgtggtaaaatctagcaatgaacatagaagagcaacagctgggaaggaggggtatgtcaggattacatttgagaattagagaacaaagtcacgcaggaatatttactataattatgagataataataaattacactgctaacagatagcccaagtccatacttcatgaagtctctataaacaaatgttaggtatatgtgaggtttaataaagagaactctaggctgagagccaagagacttggattttctctccagctgtgctctaacctagctttgtgccatagcataatacattaatagagttgggcacagaggctcacacctgtaatcctagcgactagggaggcttgaggccaggagttcaagaccagcctgggcaacaaagtgagatcatgccactgctctccagccttgattacagagcgagaccctgacttattttatttattttgttttaatttaattacttttttttttcagacgaagtctggctctgtcgcccaggctggagtgcaatggcatgatctcggctcactgcaacctctgcttcccaggttcaagagattctcctgcctcagcctcccaagtagctgggactactggcgcacactaccacacctggctaattttttgtatttttagtagagacggggttttaccatattccccaaactggtctcggactcctgacctcaagtgatctgcccgcctcagcctcccaaagtgctgagattacaggtgtgagccaccgcatctggcctgagaccctgacttcttttaaaaaagcaaaacaatacattaatggtctctgaatctcttttctcttatctgaaaatgaagaatttttggtagtattttcttatgatttcttccagcattaatctacccaagttaaggctggaataagtttcctttatgatattaatacctctcctcagcattgaactaaatgatccacaggcccaaatcttcatcgtcccccaaactgctgccctgttgtccctgaatatagcgtccatttgtaattccaggcagtgggctgtaatgggcccttgatttattgcgcccttttcctaccgtgtaaatagcccagctcactgcttcttgggtgggataattatgaaccttgtggccctcagatttctcagtgggatcgggctccagttacccacagtggtaactggcttgataacagcattgtttattgtttctttcctactcctgtctcacttctctacttctggccattgtattctgaggtcacctgagattcttgtctcaagatcttcttgctggggaaactcaaaggaagatatccacctattcaaatcctgcctgttttcctccctctagcttcattctatagccttggaaggttcgtcctggcctgttcaagcctgttttcctctctctagcttgattccacagccttcgaagtttcttcctggcctgttcaaacacaagctcatggagctgcaccagactcttaccacatttgtcattggaaccaagtaatgcaacatcacatatgattatatgcgtgttctttttttaaattttatttctcacagccttggaagctgggaaatgcaaaatcaaggcctggcaggggctggcttttgagacagctaggtgttagctgttacttcctatggaggaaggggcaaggaacctctcttgtgtctctcttttttttttcaatacatttaatagtatatatagttaaggcctataatatgagacacattcagatagtaaaatgattactatagtgaagcaaattaacagattcatcatcttacagtttcccattttgtgtatgtgtgacaagagcaattatatctacttacatagcaaaaaaaaatcccacatgccacaccactttcttaactatcctcctcatgttgtacattagatctctaggcgtgtttattctacccgtctgttactttgtatcctttgagctacatctctccgttcgtctcacctacattcatgttcgtactttttatgtcccttcccctcccaagcataatataaaccgccaagagccaggaactctttttttaatttcatttttattaaaaaaaaataatgcccctctatgcctagcatggaactaatgcagaatgtacccatgtagtgtattgtcactgaatgaataatttagtctgagtaagtctatatccccaggactgattttgtggatgccagccatctcttcttggatttctttgccttttaattaacttcccattagacttgtggttcttagtgacctcctgagggcctgaaaatcagaaggttgcagactgggccatctattttatgggagtaatataaagacatactctctttggtcacgttttcagaaccttttgactaaatgggcagaagtaattgggaataaaaatgtgttgggaagtagaagttataatttcttatttttttctaataaggactttaattctaaattcattcatagctttgttttaaagttattgtcagtattttatgaagttaaagacaaattcaaacattaatgattctagatgttttgcttcaagtatctttgccactgtttcctcctgtgagatggagtctagattttctttccttctcttcctctctctctttttcttctcttcctctctctctttttcttctcttgtacagaataagcctgattttttttaattttgtgatattttaaaaattctcttttattttgattgatattgcatatgcttaaaaattggtagaagaggctgggtgcagtagcacatgcctgtaatcccagcgctttgagaggccaaggcgggtggatcatgaggtcaagagatcgataccatcctggccaacatgatgaaaccccgtctctactaaaaatacaaaaattagctgggtgtggtggcacacacctgtagtcccagctactgtggaggctgaggcaggagaatcacctgaacgcaggaggtggaggttgcagtgagcagagatgatgccactgcactccagcctggtgacagagcaagattctatattaaaaaaaaaaaaaaaattggtagaagaattcaagtgagtgaaactgagagtttatggttttctccagcaaatcagtgagtgttttccctgaacatggatgctttggctctggtcttcacactctgtgagatgaggaccagcccttgtggcctctgacttccaagacttcagtacctgagggtattattacatattttatgagtttaaaaattgaggaaacttttttcccctccaacagtgaaacattctatttatcatttgttgaacctgtctagtgagtactgattttgtagaatacttccccaaaagctgattttccagattcagttcttttcaaactgcaaccagcccggctgggcagacagccctctccttttgctccgctttattcttcctgaattgactttatcactgtccctccagccatttccaggattcatcacagattatctctgcttgttggcagaaagcaagcaccgccgagactgaagggcacaattgccgaaaggttcttctttcagttcagtcctcattctaatttttaacttatttggtgctgctgtggaaaagctgtttgcctgaaatatggtaaataaataaataatatcctacatatggagtccataaaataggatgcagaaagctaggagctcaaatttagatccaaggcagtaattctccttgcttctttttccgcttcccttcttagcctcccttttctccttaaatgatcaggctgaatggggttgtcaggattgaaagaacaggatcccagattttataaaattgtttactcctctctgtttgaaatgtgtaactttgcagaattgagtgtaattccagtcatctcctaaaaggctgggatgatggccagggcgaatgggcttcctgaccttttctgtgtggagaggcttcacggaggagcactgagggcagaagacacagagccagtcttccatggaggcgacccatagcagcgggatccagcaatgtgtgaagtcatgctggttttacatatgaaccaatttgaatagaatccttcattttttttacataaatattacatcttaaccttttcatagaagagcctcggttttctttccaaaggtataaaggcgaggtctgtgtttccataagcagagaacatttatcctctgtcctgcctccctctagaacaaaatccattgctgtcttaatttccagttttgattgtagctctcagtgtgagacctcccagtgctgtagagtgtgtttcctctatgaggctcactcaccacaggcataaagatcggggtgaatttcccagccgcctacatccgggaatctctcattcggactcagcaagatcatttttatttttgaccagaaccttataaataaatcacaaatatataaatgtgatagggaaggcgcccatcacaactatttgttcaaacaaatcctgggcccaaagaaggagtgaaaaattaacttcctatcactttattttagtagttcatactgacagcaaatatttaattatccattattttgaattccacattaaaataatactcataaggtttggattaatagaaaatactcatatttataatagttagagctttccagatacatagaggcaatatagtctagtgcttggtaattccctagagttggaaaccttggtttaaacctggcctttacatcaaacaagctatgtgtgcataggaaactctgagctctttgtttcagttctctcatctgtaaaagagacacaacaatagtgactaactcacaggattgttctaaggataatatgagatgatgtgtaacacatacaatacctaaaacttggtaagcactgttaacattaactagtaatagcatttcagtctcttttctgttcattacgacatttaatcttcctgataacctcttattataatatacactgtggtagactaactttgctttaaagggccagatagtaaatatgttcagctttgccagctgtatggtttcacttataaacactcaactctgccagtatagttcgaaagaagccaaaggcaatgtaaatgtaagggtgtgtctgtgttccaataaaactttgtttacaaaactaggtgtcaaatgagatttgacctggggactgtagtttgctgattcttgacaactctctacttgctgttacaaataagaacatgaaagcagcttggttaggagattgactgtgagaacattgctacttagtggtatatttcaaagtaatatccatttttttaaaacttatttcagggcttttctgcacaactttttgtttgtttgttgcttttattttgagactgagtctagctctgtcacccaggctggagtgcagtggcacgatctctgctcaatgcaacctccccctcccacgttcaagcgattctcctgcctcagcctcccgagtagctgggattacaggtgcccgccaccatgcccagctaatttttttgtatttttagtagagacggtgtttcactttgttggccaggctggtctcgaactcctgacctcgtgatccacccacctcggcctcccaaagtgctggaattacaggtgtgagccaccgtgcctgacctgaacacctgtttttgatggcaatttcttatctagtgatcatctgcaatgtctgagatatagacttatgtacatcattggttagagtgtgggttgatgtgagcagtcttctttgactttgttttatagccaagagttcagctttaaatactgagcaaacttcctgccagcatggattttggttagaaaaagaaatgggcaaaagtagatgcctgtttcaatcctgactgaggaacaaatgtagcacctcaaagcatttctttatacttatacatttctttaggttttttatataacactaaaatacttacttttttttttcagtcaaaaatatattcctgagttctaaatctttaatttgggggacatggatcaaaattttgaaattttggttgtaaaagacacctagaggggcacgaagtctgtggcttgtgcaaaatcttttacacatgcttcaaggatgcacacacatatacaaacacacactctcacacactcacataaggtaaggagggtgtttgggtgtataaaagcaaacagtagaagctgcctcaaaccactgtatccagtatatatcctgatccaacatatatgtatttagattcaaatttaataggtctggcgtcaaatttctgaacccatcacaaagtagaagcaataaatacaaaaaaggcatattgttcataaagcgtgactggctgtagcaagagatgacagctgacctttggatactaaactagccataaaactgaaaaatcatgccatgataccttgttgaatcacttcttaagtaaaggttaacttacatacattacattctgattgtttaaacagaaacaagtgtagtatcttttaggattaggtcattttaaatttattctgacaattagaagttttgattcttcaatttgttaaattgagttttctggaaaatgtacctctttctgaagttgaagttggataaatgtagcaattccacatgttcatcaatgtgttacagcctaaaattcatcttttaaatgagaatattaatttcatgtttataaacatattttctaattgatcaactgtatttatttttatttatatatttctccatgcaaaatagaaatagctctttactcagatgagtgatactgaatctaatataaaagcaaatttgtatagaagaaatccagggacagcagcggtcagaagataattcacaacttgatgaggtaaactaccttgaatacccctgagaatgagagagtaagcaaggagacctcgagtggccaaagcagagatttcagttatatttactggacaaaatggacaccataatcaacagggaaacacaggatgtactttgggtgagtggtaaagttctgcccatatgaaggcatactcccatttatttgctcagtcttggcctggtgacaggcaacaaatattgaataagaccctttaaatgaattttcaaaaaatgaagtttagtgatttaaatagcatttaaaaaaatcaaattcatagtaagggtgcagtaaatatttggtttacagtttcatcttgcatactgtggaaagacgatgagcatggaacttgttatcaccacgtagaattcctaaaataattgtttcaataaatacggaatagtagctcaggtttcagatttttacatgttattgactgagcctccctttggggaaaatttaaaagttaaaagatctcttttaagatgattcagaaatgcaaggtttatttaacatcttcctcattgccatattgtgttctgttgttttcctcatatcatgtaacttattatcattttttattacttagtttcatttttacttcctttacctactcactcattaattcttactgccagtattttaaaacctttctgcaaaaaaacacatgcaactgcactgggtcagtgtttctcctgattgataatccactttccacctccacatctaagtatacaatcattgataaaaatgaagcccccatggactcttctcctgagagatctcattcttcctgcttatcagcttctgccctctgtctgagggattccatattggcatctccgaaatggagatattttcctatcaggtgtattggagttaaaattgagagagaacatgcaatcatttttatcttttcctgaatcatatgcaagtttagcaccaggtcgaaaattcaagcttagacttgtttgtgctctaaagattgagaaagttgctcagattgctctggagtgggtcatgagttttcttcctggatttttgttcaacacagatagccatctttgatttattggaacctcttgctagagcatagttataactcccagagaatccttttgaagtcaatttcagctttttcatattcaaggaaaagaggaataaatcatgtatccatttttgatctgtagtttttcaggaatcattctcaatgttgttgaagaagttagaaaagcccaagctaatcactgtatcatataggttttccgaaggcaaggtgtagaaatttttagtgttgtttaagcaacccatttattttgaagtattgaaatgttattaatcctaaagaccaggtgatagtttatatattcttgaaggctttaaaaatataattagcctctctgttacaaattgagtccacattcatcttggggctaatttatttcctttacaaaactaacgagtgtttgtctacaggatcagtgaactaaatctaaatgggggccaaaccttcaacttcaccctctggcaactctttttcccattttcagaactcttccaaatcccccgccccagccccagtatttccaattgacttatagaaacagttgcattgttcttttgcccaaatcccaagcattccccagagagctgttttcactttctttagagcacttacagtttatctctgtaagagaatagttttgagtttggcacttagtctgtttctttttcattctaataggaatcgccttagagctagctaagtccctgttagtcagcttcttaagtgctgaccagacttcttccatctgtatagaacactcactttttcacatcagaggtttaatgaaactagaaaagaaaactctttaaaataacaataataatgaaaatctctaatagattcaggcaactttacatatatcttttcaagattgggtcaattttgcaaaaattttgagggttttattttttaatatggcctcaggttagagtcacacaaatcagttaaaaaatatatttctttgagttggaaatacacacttatttcatccctgtacttctatataggggagttatttttaatgagaaaaatttatagctgactgccaatgacacataaaaattagtatgcattattaaaaataaattaaggcagaaagcagccaaagtggactttgttctagagtcttggtaaacagccaacagcagtgctcacttgtcttcatgtgacattaaatagtgcccgtctaaaaagtgattaatagataccgcgggttggaacaggctggcattcgtctgtttcttacagctcctgatacacgttgaatgccctgcatacctatagttcttaagggaatagtcactgttgagacatttagagaagctgatatcagatgagggcaatcttgttttggctattttaccacatctcaagtatacaaagtctacatataaacattacgtaatgccttcagacattgcactgattcaaatagattttaatgagaaaggccaacttttcctgtttcttggtcattcagagacttttagggagcttgaattgtcagtatctcctaatctctcaactatttttttcttttgatttttaatctcactcagttagactgttgggaagagaatacaataggaggattaatggctcagagcagaaatgtttgcttgttggacaataggaagggaatttggtagaagttcttacccttcctgtttacattcagtaatgttgctggtatattgaaaagactgtcaatagtgggtatatatttttttcaacagtaatttccaacatcttgttgttaggtgttcatcaaaataagaaagacggagaaagaagaaaacagagacaaaaagaaaaaagataatggatttgagaagtcaagtcaattcagtcacaatatgggagtaaaggacagattaaaagaagtttcttgtgtgagtgtgtgtgtgtgaatgagtgtgaaaatgcgtgcatgggtacatgtgccttagagtagaggtaattggaagacttgaggagaaattactcacttttcttttaataccaatgaccagacagcttgccaggtgctcactcagatttgtatcatatctttacatactgtcttctggataggtacaactatccccatttttcagatgaggacacagaatcttagagaaatgaagaactagatcaagatctgtttgaacgtaagtggttgagtcaggatttgaatacaggctttttgtttttatcactccagagtctcttttttcttccttggtaaatccagacttatcactggagattctggttcaaaattactctggcagttttaccacctaatatatgttactccaagaattttccaagtctgattaaatagattaggtggagtcctccgaaaccctttcctgatttcctgggccaaggtaaagcatatctcagagcaaattttaaacagtactttgtcattgaagacctaactatatatgaagcattgtgtaggtgctgagaaaggcacagaaaaatatacaatagggcacttgccaccagtgccttattaattagataaagagataaaacatacacctgtgaaaagctaaaaaaattactattatcaattgacaatttggcatagcaaaacaaggcatgattaattgccagataacacaaaatgcatgtggtagaatttgagagatctgtaattggacttcagtggcctgataattcttaatggaagcggtttaagctggagggaaaggatgggcaggatttagacagggagaacagaggtgggagatgaattcaggccttaacaaaagtgtaaagaagagcaggacagcaggaggctgggttgaaggacataaacaacaggaaggtaagtaaactactttggacaaagtggggctctgcatagataggaagtggaaaagcaacctcaaaaataggttgggctcaggttttcaatcctgagtgccagcatagactgagcctgttgccatgggtacgtggaaaatgacagagtcagtattgcactttgagaagattattcaggaggcagggtgcaggatagaggacgagtgtctacaaataaagagtgaggcaacacatatgtccatcctgcattgggccacaccaagaacctaccatgtgcacctctcaccacccactggcgctcagactgctgcacacagtagcccccaactcatctacccagatccacttttgtccccatccactctgttctccacagtttcagccagagtgatctttacaaaacataaattattgtcacctcctgcaaaagatttcaacgtgacccataaatatattcttattttttcctccatgtcctatccctcaacatgacctacaagacctggcctctgccttctcttcggtctcatccttcaccctgctcactcttgttttctaggcatggtggtctttttaaaaactgtgtctcattctttgtgttcaacatgccccctctcatgatagggactttgctgtttcctcttcctggcattctcttctttcccctcattgtcttgtcaactcctacttatccttcacatcaacacactctaatttcaagacctccttgactaggtcagatccccttatagaagggtctcacagctccaagtaactatctctcctttgcagcttttattacatgtgcggtttcaccacttatctaatagttaattcatgtttcttttccgcagtgtccacagtgtttttgttctttatttaattcaagaatctagctcttagtggactctcaataaatataatatagtggaaacaaaataatatgtggttaaaatgtaaggtgttgtattagtccattctcatgctgctaataaagacatacctgagactgggtaatttataaaggaaagaggtttcattgtctcacagttcagcatggctggggaggcctcaggaaacttacaatcatggcagaagggaaagcaaacacattatgcttctcatggtggcggcaagaagaatgagagctgagcgaagggggaagcctcttataaaaccatcagatctcatgaggacttactatcacaataatagcatgcagaaaactgtctccatgattcaattacctcccactgggtccctctcaccataggtggggattatgggaactacagttcaagatgagatttgggtggggacacagccaaaccatatcagatgttataaaaatttctatatttgaaggcctcagctattggcaacattacttaattttaaatacatttggcactgattttaaaaaagtgttacatagtattggaattattttcagagggctgaagaatccttcataccttggagagtgagtgagcactctttagcaggcctcttgtgcttccaacctaaatgcaggcaaacgtcctgttggtatgtaaagctgccacccaaatgcagagaacctctagagtgcatgctgttctcattcaaactgtcccatctgttcagacatggtcaagctctctgagccctgggagaacgaaaacaggccaggattaccagtttttacagattttaacgtgaggcttagggtctgtgggctaaaaggttgattgtagtttttaagttaaacatcaacaggggctgaaaagaccctaaaattacatttgggagtcatacaaagacaatacagctccaactgcattactcgggacctttttgctgctgaaacagaaaaaatgataattaaccaatcaggatgaaatgtcaatttgagaggaaggtaatgtgaaattttcctaaatcatctaaacaccaaaaaatctgttacatctgatttccaacctgctctgttgctatgaaaacttactctccactcagctctctgaacgctacatattcatgcaattataattctttctgaaagatggactctgtaatgatatgaaggcgttttccttcagtctgcctagagtttttccagagccacttaataagagccatgctcttttggaattattttgctttatccacatttttcttcatgatccaaataaaagatagttttttaaatgtgaggtggcagttgtcttgggatatatctctatggcatttgctaaattaaagctcatcttttcaagcccagtctttattttgttttcctatagtttgctggcaaaatcaaagcccttgcttccttactcttgcactgtggagcagactggtaggatgatcacaggggagtgagcaggcttcagtggttcttaaaaagacaatttccatttccttggcagagggaccccatactgcgctccagccaattcttaattctttctgccattggttccgaggggcaggcttttgtggggagggattatttgtttctttaaaatccaccgtggttcttttccctcccaccttttcccctttcttttgtggcctggaacaatacaatgttagcgattcagtttctgacttgcagagaatccatctatgcttggaaaaatgcagttcaattatatactgcagcttgaggtgagatagaagtgaagatggcttaacacgtgaagtgggtaaaaaaaatgtgtaattgaaacagtatgatgttgatgaggcagtgtgtgaggctgtcaggaggcattataataagctgatgaacgagactagcttcctagttctgctgtatgcaaatgttccattatttttggtggaggaaaggaacctggcatattaattggctttgtttttagagatgcaggtgaagccttttcattttgctttctgaaaagaaacttgcaatatgtccttaaattatgtttaattttgagtgtcgacttacaaagaaataaaaactcttcatttttaaaaaatttaaaacaaaaaaaaatttgggggtattgaaccttagaaccaatcactaaaaattctgattttgtgtcgactaaaaattctgattttgtgtcaactaaactgcatatgagatcttcgagtttttaacactgaaacataatagttaattttttaaagtactataaaacagaatatagaaaataaattacactatactatattttctatatttggaagtttacagttgtttgcataattgacaagttcgtttcctggtgcagtcatcagcaggttatacaggatgtatctatctgtctctttcttcagaggacactgtgtgtgtgttgagaatgaaaccgaatgtgggtggtaagaggaaatattaatgaacttttaaatatctctttccttgaaaagactgaaatatgaggtcttaagtaaaataaatcatttaaagtataaaatgcttaaagatccttactttttattaccaagttattagcagactgccatactgaataccttttatgtagttttttttttttttggctaacatttccaaacaactttaaaatatagttattcattaaccgacttgtgactaatctttttcagagagagaggattaactttattcctctccagttttaacgtgaccaataaggtgatatgcaagtgaggatttggggaggtggggaagaattggagagaggtaatagaactgatccttgagtcagtgggatgttggaagtggttttccattactttccttggttctcagaaaaccagggagatagggaggatgttatcaggccctttgaccttctggaagtgactgtggacttagcaaaagctagttggagctaggggaggaaggaggcagatagataaagtaggaagaaataattgttctccctaagcacagaatccaaggtggtgctattaaaacaaacaaaccaaaaatacacacacacacacaaatgcacacacacacgtctgtgaatgtatacagagatggtgcggtggctcgcgcctgtaatcccagcactttgtgagcccaaggtgggcagatcatgaggtcaggagttcgagatcagcctgaccaacatggtgaaaccccgtctctacaaaaaatacaaaaatttgccaggcgtggtggcacgtgcctgtaatcccagctactcaggaggctgaggcaggagaattgcttgaatccaggaggcggaggttgtggtgagctgagatcacaccactgcactccagcctgggcgacagagagagactctgtctcaaaaaaaaaaaaaaaaaaaaaaaaaagaagagatatatatgtgtatatatattaatatgttgacaccacagagtacagtattagaggaaacagtgtgggtgcatgtgattcaaacatcagttgtgaggccgaaagagaagctagtcaacaggtgggggtcttttaactccttctctccctccactgatacagaacccccaacactcatatacagtgtgtttccagaaatccaacctggctatccctttgaggctgataaaggagccaagtatccaacctgagatcctgtggttcatggagtctgagttcctattgaacacagatcatggttgcctggatgggaaacctggtttaaacatttaaatgatcagaatcagagcagcctgaaacagtcatccttgatgctcaagttcctgagaaataattactagaaacaaaatttcattgtttggaaacttttccagaaaatgataaaataatactcgtgagaacatagatcacagaaaaagaaagttcagttctaatgtagtatgtttcttttacctagatttattcattgttcctgtgtttattttctttaacaaatataaacaaagaagaaaaggcagcctcctgtatagaatgcttacacattttataagttaaaaatacatatagtcagccgggtgtggtggctcacgtctgtaatcctaacactttgggaggctgaggcgggcagatcacgagatcaagagatcaagaccatcctggccaacatggtgaaaccccatctctactaaaaatacaaagattagatgggcatggtggtgtgcacctgtagtcccagctacttgggagtctgaggcaggagaatcacttgaactcgggaggcagaggttgcagtgagcgagatcgcgccactgcactccagcctggcgacagagtgagactccatcttaaaaaaaaaaaaatacaaatagtcattttatagtttagtctaagcatttattacacatttcaaaagacaaataaactctctcctacttttgtccacctgtaagactcatttcagtacctattttattttctcctagtttttcccatggtcttagtttaagaattcccaaattctcacttattgaattcactcacagaattctacttcccactacagttctatcaggaataggcaagatagaaagaaaaaaaaaaaaaagaaagaaagaaagaaaaagaaaataaagaaagaaaaagggatgggaattttgcaaacatgggggcctgattactaaaagccttatgagatgctcatactcattctttaaagaatattggaaataaatcagtcatgcatttaattaaaccatcctaaaatgtgcccctcttaaaaaaaaatgagtgccataatacttcccaaattcccggaaatgttgtatgtctaagaaagcaagatctgaactgtaggtgtatttcagttggaaattgtagtttacattacttctaattcgaggcctatgtttggtcattaaaagctcccagctaaaaacagtgaccctgctctccatgtgtgcgcaatcttcagccaagtcccaccagagcattggcccttcagtggagggagaaaggatgatagaaaaagaaattctgtggatgtgagaggttagggatagaagggtatttgggcagctctggctatctcatatctggaatttcaccttttatcttcctggaggatgactccttatatggtctgctttgtagaccactttcttgaaaagcaattgcatataatataaaacagaggatgctgtgctaaaaagaaaaacaaccctccttttattgatacttttttctcaaatatagtgatcactacacgatagtaataatggtttgatatttgtaaatcttaggtcttaggaaaaaccacatatggtctgttaacctaaatgatctttagaataaagtacagcgttctaatcaattcaattcatatttcacatgtagttattctttgactaaacaagtactttttgttaaaggaagcaggtaaactaaaatttatgtatttcctcttctgaagtccctgacgtagttggtttggaaaaggtctccaaccaaccagggtgctgaacattcatcctgagtaatgtgctgttttggttgataacagttgtcatagtcatttcctcctttagttagcattttggcctaaaggtagtagatttatggtttttagcctgtttcatttcccagctgccccacaacttttttttttttttttttttttttttttttttttgtgaggcagagtctcgctctgttgccaggttggtgtgctgtggcgccatctcggctcactgcaacctctgactccctggttcaagtgattctcctgcctcagcttcctctgtagctaagattacaggcttgcgccaccacctccagctaatttttgtatttttagtagagacggggtttcaccatgttggccaggatggtctcaatctcatgacctcgtgatctgccctcctcagccccgcaatgtgctgggattacaggcagaagccactgctcccgcccacaaaacttcttttaaccacatttacaaattgctgggtgcttctgcatacacacataatgaattataaatattagataaaaagtatgttgaagtaaattgaacattaaaactcaaggagttggccgggcatggtggctcaagcctgtaatcccagcacttagggaggccgaggcgggtgggttgcttgagctcgggagttagcgaccagcctgggcaacacgatgaaaccccgtctctactaaaatacaaaaagttagctaggcatggcgttgggcgcctgtagtcccagctactcgggaggctgaggcaggagaattgcttgaacccaggaggtggaggttgcagtgagccgagatcgtgccacttcactccagcctgggcaacaaagcaagaccccatctcaaaaaaaaaaaaaaaagaaaagaaaaagaaaagaatctctcaaatgtgaaagtctggatacacaactatgtttgcacaacgctcaatttggcataattataaattgcactccagcctgggtgacagagcgagatactgtctcaaaaacaaatgaaccagaaaacccccacaaaactcaaggagttaatttacatttagaccaatctagatgtgtttaaaataaaagtaaaaatttcagttctgtaagaagtgtctactggggcaagtacaattagtcctggcttacacatgagaaataattgcctattgtctattattttattgcctaggttactgccaaagcttgtgggtgattcctctgaccctttgtactaaaggggctttctgaattgcctttcttcataggtttcttctgtattgaaaaggctttcatggcttttcatgtccttagaatgaagttgaatttcctaagcctgacattcaagactctcctaaatttagatgaaagttaccttcccaacctcatgaatcattatgctaccttaagacaatttcaaccaagataggcttttccttgttacctccatgacttccttcattcagctgctctaaccatgcagtgacctctctaatcctccccttctcttaaggaaccgtgtggtagaaattatatagacttaggcccatgacagactagaattctatgttggaaaagccactgcttccctctggggctcagttcctgactcagtaaagaggtatcagttactggcacagtaatgccccataacaaacaaccacaaaatttcagtggcatagacacttatttatccttcatttgtgggtggctgggctcagttcaagacttcttcataagactctcattttttgatgatcagtgagagataaggattgtttttctcatgggcttggcagaaaatctgaatgtacatgtgcaattcaaggctttgctggcgcagtgtccactttggcctcagaaagtcacatcatcagagtggggaaatatagtccactcctagtgggaggaactacaatgtcattgggaaaaaaggcatagatatggggatgaggtaaagaattgagaacaatgatggagcctccagtagtattattaagaggttaactcagataatctaggttaggtttctgacagggcatgtggcacaaagaccctgaacacgtttttctttccccctgtactttcctcacacccacttgttcaaactctccttcttcctttagtcttgcagctgttattctatcactggcacttcctgtgcttttcacatagtaagcagtaagtaaatggtttttaaacataattctataatcattatttgcttttttattgaaatacatatggaacagcctatatgtagcccttgtatcttctcatcaatcctaagttttaagttcaagtagaatttagttgccaatttagacacctatattggttcccaaatgtaatgaaacaaagctaataaaattctttaaacaaaaaacaaaaacaaaaaggtattgtctctgcttcttagtagcactttctctatagccatctctttgagtgatgtctgactttatcttctgccaaagatagataatgtttatatcagacaaaaaaataattataataacataagatcgtaagaaatgacttgtcagcttatattaatctgactttggtctctgatcatggccaccagatatatttggtggaaccactcccttgtcagaccaccttgcaggttaaatctgtaacccaaacacctccccacttctcttttaattctcagctttttaaactttaagtggcttaaatttgatctttacattccactgtcattccagcacatacacaaaaatatgtattttgtgctatctccttggtgtagtgactgtgtggtaagatggaaagactattattgagcttggaatcaagtccctgctttggcacgcgttagctgggctgcagttttctcatcaggagcatgattcagattgtttattcttatatatcctttttgattattaccttttgcagctctattcactggaaatgaggggactagaaaagagaaaaaagagataaaacattgactaacgtgtctttgtgccattttcagtcactgctttggaatctggcaggagagctaatattcctgtttcatttttattgggcttaaaatatatgtttatcttctcttgatgaagatttggtattttttttatccctcggatttcttctttgaggtgactaaatgtgctgtttcttagaaagcttggctggaacttttcatctagtgtgctagagtctctataaaacatatctaaataattttcaaagactttgctttaaatgcctgttgaattctcctgggtaatattagctgagtttcctcatgtacatttggtggtacatttttataattatttctatttggtgctattcggcttttcacaaaaattatgtatctggtcatatcccttggtctgtgggccattgtgactcagatttcagattgcatacgtatgtgttaaatggagtttcattctcgtaaaagaaaccttactgaacatgaccactcttctagtggtttccatgtgaaatgaattatgttctattgtaatctggagtcttttcattttcctgtgagaaatggtttgaaaattgtattctgttgtttacactgttgggtatctcttaggaggcttatacagaggataagaactaagatagctttgctctccttacttcttggtgtatctacatagcataaaaattaagatttatttcttaaggactatgaatgttttgtaacattcaattttgagacattcaaatatgctgagtgttttttaaacagatactctgtaaaaatgaatgtactaagttctcagactaaggtgtttttttttcccactcatatgtagaggaagtttggtgttgtggttaaaattatgaactctggggtaagactgatttgatttgggtatcaatctctgcctctatttgactgagtaaatttcataactaccttaaagctccgtttcatcacctttaaaatggggataataatagttcccatcacccattttactcaacaagatttatcaaaggcccaatatgtgtgagtttatgttgtaaatggtagggatgccccataagagaaaattcctatttttgacttctactgaaaggaaataagcaacatgagtaaatgtgcatgaaaaagcagtagaaacaactctgataaaataggattgggcactatattaggttcaatagtttatgaaatcctttctgcagaggatatttttaagctggggctttaagaaggaaatgagagaagagcattcaagcaaaggaaacacatatggtaacaattctgtgctaagaatgagtttgctatattcgagtaaaaggcaaaaaggccagtgagacttgagcatgatcatctaaggagaaagtcattcaggtattagacaaagacaggctcaggaactgtagagtcctgtaagccaagaaaggagatggggttttatttgaagtatgttgggagccactggaaggttgtgaggaggaagcaccatggcttgcttagtatttttttacatattacttgggatattgtgtggagaatggaatgtacaaagaaggcatgttatgaggctactgcaatagcccagatgagaaatagtagtggattagatgagggtggtacttctggagatggagacaaatgggtagtttcagagtatgttttgggggtgaagtcaacaggcttgctcatggattggatatggggagtgaaaggatgggaagaatcaagaacaaatcctaggtttttggcttgagcaactgatggatgacaacaccatttcctgagatacgagagggaggagaagcaggttttggaagtgataacaagagttgtttcttggccttgttaacagctacttcagggtattaagtagcacttgaaaatgtgaatctggagttagggggccagtcagggataaaaatataaattttggagtcattggtttataagtattgagaatggatgagatcacctaagcagagaatggagatggaaaaaagaagcttccccagaatgaatagtgtagtgcaccagtgtttagacatcagggagaagagaaatcagcaaaggagacagagaaggcatgcaaactgagctagaaagaaaaatagaatatgaagcccttagcatgctcatatatagtagcttctctataaatgttgatatattatgtgtgtttccccagaacactgagataaggagactgagagatggtccctggaagtgctggtacggaagtagaaagtgaggcaatggaaggagaggaagccagcaaagcttgtgttttcaagcaggttaccagcaaaaaactgaagctccattctgctggtgaccgctgggaaacaatatagaatatgcctcagagtagccgccccagagggtgaggacatagatgtattcatcctccaacccccatttgtcattaactgagggctgctctctggtgagtgaactcctcagcactttggggctgctctatatgggccaagaaaaagcccttaggggttgcagatgctgtttgcacaggaaacagtgtgtgcacccacagtgtgtgctagaacaggtgctgagcagatctgacagtggttcctgttatcatgtcccttacgtgactggctctcatcattatacctttcttcattgaaatattataggaacaaaggaaattccaattgataaaaatgaattattaaaacaagagagaattcaaaattcttcataatggtcataccaaaagatgtgatgaactcattgaagcatattaaccaatggctcagtaattctccttatattcttgtttgaaagtagcaataaattttaaggcatattccttgagtgccaaagacatcattaaatgtgacaccatcaaatatgaagatgaacacatataaccttgatattttgaaatactagaataagaattcataccatacagtaccttgaaatccaatgcctttctcccaaagggatcaaaggttacgcttgatgcttttcagggcaccttgtacacaggagatcacttgatcctaactcctgggatcagaacgaatgaagcgattagtgtcacaggcgaaactgaattgcttttaagcttcttatctgagcaagtgtcgatactgagatcaagacttaggtttgctaaactctgatttggtttcctcatctctctgccataatggaaatagtaaaatgtttcctagtgcttataatatgccagacactgccctaatcactttacaaaattagctaattttatcgtcaaaacaacactatggcttaagtagcattattgtcttgcttttaactactcgggcatcaagttaggaaactggttcagttcacatctcataagtacgaaagtagggattcaaacccaggcacctgcctccagctctgttctcctcagatgactcttacacagctgttacacagcttatgtggcagtaataggctgtgatcttatccctgactatatgaattacttggaaaaaatcacacacatgatgtgtttactactttttccataaatccactttaaaaatcattttaccagaggttaaaaaaaaccctcccatcagcagtcttatttataattgaaaaaatttaggttcctttttattaaatctctttcatatggtttaaaccatatggtgactaattttttatacagtctaaagtgtatacaatttgttcaatgtagttttgcctttttgtgaattcctatgctttatcattaggctgaaaagcatgcaggataccagaaatactcttaccagtaaacttccattgaaaatctggctatggaagaaaagtctgccagccagtactttgtactttggaaaggaagccatagatccagatattctccaagaaatacaggcagtggctcatgcctgtaaacccagcactttgggaggctgaggtggattgatcacttgagcccaggagtccaacaccagcctgggcaacatagtgagaccctgtctctacaaaaaaataatttaaaaattagcctggcatggtggcatgcacctgtggtcacagctacttgggaggctgaggtaggaggatcatttgagcctgggaggttgaagctgcagtgagccatgattactccatgacattccagcctgggcaatggagtgagaccctgtctcaaaacagaaagagagagagagagagagaagaaacaaagtagttactttatcactccccaaatgtaatttatcaactgtctcttcagtctcatttgctgttacctgcctgctataccaagtaactaatcataattttcaaaggaatttcaaatatgttacgtcatttgatctcagtaagatttttgatgccaggtagatctgcaagattactttcataacacaggagaatctgatattccacctttagggaaagggattgctcctggaagctctttccaactcttttcccatatggaagaattttccagtcccatttcactctgagatattattattacttttcctggctactttatattagtgactattttaaatcctactggaggggatttaaaggctcttgtgcaatcctttcatagcccatgaatttcaagaataagagttgcttaacttactggccccagaattctgtttccacttatctctatgttaaactagagccacagagaaaaattatgacccagtaatttcttctcttatttaaaatgtcaagctcctatgtcctgaaagttagtactagattttatatgtctgcattttagttttagttttgttttttatttcagatcggaagaaaatgaagtattctgttaatttaaagttacttatggcacatccctgtaatactaatcacttaaagatgtagcaatttatattttttacagtgttaattcataagtggataggactgtgaacaaatgaattaaaccgaagtccttataatttaaacattcctttttggaaagtactttaaaaataaactgacttaaatacttcctatttgaattattattttctttattcttctcatattggttctaagatatgcaattttatatagcatacgtaatagctaaatgttaaagactgaatacctgtgcttctctttaaagtctgttttgtcttctggctaaagccagattccatttaaaaaccttacagaatatgagacactattttaccattattgtttgtgtcaactgcagccagagatgagctcccgatatctctggaataatttagaagttgatgccaagtcatgattctggtcaatacagtaatttcagttttgtaaagtttatttatttaaaaaaattagttcagtgtttcattcatgatttttgtaataccacaaggaagaatagaaaaatgtaaggataagcatgagaaacaaattagttgataaattattataagcttcttataataatgtcaactcagataactctccatgtaagctgcatatgagcataaataaagttaactgtatgattaatctctactattgtgtttgcatccaagagatattaaaataaacattatggttagatagagtaaattctaaaaagctgcaaaaacatttaggttatatatttaacacatagtaatatgcctgtgtttacatcttccaattagataaatttctgataatttttgtctccttaggattttctaatgaaaatagagagcagtattttaattgtttagtatcacataattgttctagccttcatatacaatttaaaataaatggcacaaaagtgcttggtaaagcactttataaaactatatgaatttcatctgttattctgactttaacaaattatacaaatatcatagatgattataagttaaaatacagatatgctctagtagcagaatttccacataagcatgctaccgtacatactttaaaccaagaacttccatttctaatgataagattgactagactagatatgttgacaatccttttatcacgcatgaaaaacacttaatatattttatgtagtatcctcaataactgtttaagatatatgattagctggcttgaaaataaagaaattgtctaaggtcaaaggactaagtgagagctggaatctgaatacacaagggaacattgatctcctttgacctgggcaattcttaacgtctctgtgggggtaagaaccaaagcccagggcccatgcaaggtgaggagtgtttgcaactacaagctcaccatctaatggattggcggcacacattcatgcgacttatttgctcaaaaactcccaagctaaatatttactttaaggttctcttgggtgatttatagcagaaaatgagagtccttgttaaaggtacacactctcaatacaaatcacaaaataattttatgaataaagttaaaatggtcacaaactcagtatgaaaaaaagcactaaatgtacgaagaagtcaccatgatctaggatccacaaaagcagcaaaggtaggattatagtattagaatcattaggtaagaatgtaactaagtatttgcattacatttattaaaataaaagggaactaaatgttcttaagaggtgagagactataaaaaattattaaaccatttttttaggagaatcaaatagaaaattagcaaataaaataataaattttgaagagcacaacgtggatgaacaattaagacctggcaaactagaagatctaaacaattgcagcctgaagagtcaaagaggtagaaaatatgggagccagatgaagagatgtggagggtgtggtgagcagacctagcacacattcaaatgaaattccagaggaaagcatagagaaagcggaggacactggtttttgacaataaaatgggtaagaattttccagaattaatgaaagacataaatctttagtttcaggaacaccaacaaatcccaagcaggaaaaagaaaaataaatctacatctaaacacattgaggcccaatcatgctactccagagacaagactaaaattgtaaaagcagccactgagaaaggacgactcacccacatgaccaacaaccgttattagactggcaggtctctctcatggcgttagcgaaagatggaaaacattagaataaaagcttcagagtgctgggaaccacagctgtcaaaatagacttataaacccagtgaaactgtctttaaagaaggagagatacctttcaagaaattaagaacaaagaatttgctagcaacagacccttccagaaggaatttctacgttatgcacttcaagaagagaatcctaaaaggatggcacaaatatgaaaataaatagcgagaaaagaaattcatacatatatagtatatagataaatctaatataatattgactgtataaaccaataatagcatccgttcataagattcaaaaacagataaaaaaaatactggacaaaagttacatgtaagctgagaaaagggagatcaggtttaaagtgtttttttaaagatctttctattattccagaggtgaattcagattacatttaaacattgttaaattaggtatgcatgttttacataataaactctaaaataatagaaattagctgtgtattgcccaaacaggtttagcacacacacacacacacacacacacacacatgcacacacacactcacaaacacatacattaattttgcatcaaaaatattgtcttctgtaatttcaggaactattttctgctcataaccttgtaggccctacctgaatccaacaagaaaaatgtaaaaataatgctcaatcctggtaataaaagaaatcatatgtttaacaatataaagatccatcaaaaacaacactttaaagagatgaatgagactgagacctttgctggcctacctgggaggaaacgtgcctgtcctgagttcatgctgcccctataatgcaggattagagaacacatcatatttgtcctcattatagagatcgttctaatgaggaaaaaacttatgtcaccgaatctacttttctaaacagaatccacgatctcttagaagaccaggaagcccttccaacgtaccacatggtgctgacactcaatctctgcctaaatgaactcagagaactataactggtgggacatatatttagaagaaatagttatgaaaaccatagcatggtgctgccattgttatttgctaggtaggagtctgctaatagttatctccttcatgtggcttcaatttctatatgatttggggatattctaaagcactagtatttaaagtgtggtgtggggacctctggaggtcccccgggccctttcgtccaggttcatgaggtcaactctattttcatttaaatactaatgagtgatatgtgccttttttcactctctttctctcttaaatgcatggtgttttccagagggctacataacaggtgataccttaacatattgaatgcagaagcagatacgagaatccagtcgtctttttttaaaaccagacattaaagatatttgcaaagatttaaacaatgccattcttctcactaaattttttggttttgaaaacatggttatttttatatgttaatttatattcatctgtattgttaatctttacatgaattaaatattttttaaattctcgcttaatttctaatatggtaaatatctatagatataacacatagaaacacaactgtaaggtcttaatttttaagaatgtaaaggggcttctgcaaacaaaaagtttgaaaatgacttctctaatacaacagaaagggaatatttatagtccagtaagactttgaaaaggtatagagttcttaggtattttggaggagactgtggctggcgtcattttgtaatgttcctatgtagcaacatctattgggaaaaataaagcatgtgtgtatttgggggcaggtgtttctagtatttcttgggcaaactttgagtgctatgtattatctgtaatctttgtttggactttctttgtggtaaattagaaccccaaatgttttcataacttcaaccttgaactgttgttttaggatagacaccaataaatataaggggtccactgggaaggcagagagcatttttagatttatgaagggggaaaaaaatcaatagtgtccctaaggccgtgtaagtcatgagtaacacaagtattcttatgcaaagttgacaatatcatgaaacataaacctttgctttggaattttaccagaaattaaagtggcattataaaggaaagtcgatgttttagcccgtatctcaggaggaatttgtccttctgattgctttgctctgttacctcactttggctgagctctgtgaagaatttttttttcttttcccctgaaaagttaggtgacctcctcacattcttctgccttctggctcattcactttttctcccccttcaatctttgattaaagcttctaggcccctaggagttcttatttcttatacagcaagccatgcactttgtcctcttgttaaggaatgaattaataagcttaactccctctttgaagaagagtttggaatgctttcttggagaaaattaatattcaattaccaaggttgtcatctcaccaaatagaagaataaaagacatagcatagccacacttgaagataattgaaatcgaatttcagtttgtattataccttaattacccaagctttcaggggaaattcttaattcttatgtctactttcttatgaaagtgagtacatttttcctgatgcatatttataacaagactgtttaacacactgctttaaaagaacttggattgagtggttcttcttgcaatggactttggagttttagacacatcctagttacctatgaaattcatagtgtttatcttttttgacattgcataagtcctccaaaggacaataaaaataatacttctcctaattgcatcctttatattttataatattcctgtgatactttgattggtgatagtgaacaggtacataagaggcagctcagggtacttccttataggtaacccttttcctgcataggtttttaaatcacagaatatacataaacatttatgttggttaattgtatgataaaaatattttatagttaataataatttaaagatcaaacaaaaactttgtgagggcaaggagagtaagaaattgataatgtatcagtacatggagaagaattacagcatagcatagagtgtagaaaaatgaattcatagatggtaaatctacacacagataactctgggaagaattaaaatctgtgcttggcatctgcattttacatttgtttctctgggaacttggaataaacaatgaacctgcagaagcaattataaaagctttgatgcattataaaataggcaggggttttttttccccaaactggggtaaaattataaatgaagccaagtttatccaaggctgatgttgacctgtcaagctaaaatagaaccgacttgagaatccaaggacatagcattttgttggggctctagtacttatttgctgtgcaacattgagctaattgcttaacctcttaatgccttagtttccccatttgtatattgaggataatcgtgtgttctctgactacttcacaggacttttgttagaaaatatcagatactgtatgtaggcactttcaaaaatgatcttatattactgatttcaaagagttattattaagctcccttaccctctgatttctcccattctgacacatcttcttaaaaaccgtcaaagagtctgaaaacatatccctccccaccctttttttcagccaagacctcactcttacaatgtccaagaaatattttatattaaaattaacaataaggggccgggcgtggtggctcacacctgtaatcccagcactttgggaggccgaggcaggcggatcatgaggtcaggagatcaagaccatcctggctaacacagtgaaaccctgtctctactaaaaatacgaaaaaaaattagccacgtgtagtggcgggtgcctgtagtcccagctactcaggaggctgaggcaggaaaatggagtgaacctgggaggtggagcttgcagtgagccgagatcaaaccactgcactccagcctgggtaacagagtgaaactccatatcaaaaaaaacaaaaaaacaaaaaaaacaaaaacaaaaacaaaaaagcaaaaaaaaaaacaaccaataacaggaaggtactaacaactaccagagccttgttatgtcttcatccaaaaaacaactttttttttcttaatagtaactttattaaaactaaagtcttttgactccatagccaaaatgactttgataaagaaggagaaagttggagggttcacatttcccaatgttaaaacatattacaaaaatacagtagtcaaaacagcttggtactggcatgaatataggcatatagaccaatgaaatagaatttatcatccagaaataaatccatgcatctatgggccactgattttcaacaagactatcaagaccattgcatggacaaagaataatatcttcaacaaatagtactgggatgactgaatattcatatgcaaaaggatgacattgagcccttacctcataccatttacaaaaattaactcatgatagattaatgatataaatatgagctaaaactataaaacccttagaaaaaaaataggagtaagtcttcatgacttagagttggtgatggattcttacatatgacaccaacaagtaataaaagaaaaatattaatagataaattagacgttattaaaacaaaaaaagcccttttgtgcctcaaacgacactatgaagaaagtgaaaggacagcccactgaatgagagaaaatatttgcctgtcatatctgatgagtctatctagaatatataaaggacacttacaactaaacaactgaaagagaaacaatgtaagtaaaaattagacaatgaacttgaaaagacatttgtctaaagaaggtatacgaatggccaacaagcacatgaagcacatgaacaggcgtccacactgtcagtcattagggaagtgcaaatgaaaaccaaagtgaaatacctcttcacacccctgataatggcaaataataataaaaaacaagtaacaagtgttggtgagaatgcggagaaattgaatggaccctgcatactttgctggtggaaatataaagtggtgcaaccaggctggcatggtggctcatgtttgtaatcccagcactttaggaggctgaggtgggtggcttgcttgagcccaggagttcgtgaccagcctggacaatgtggcaaaaccgtgtctctattttaaaaatacaaaaattagctggacatgatggtgcatgcctgtagtctcagctacttgggaggctgaggtggaaggatcacctgatcccaggaggtggttttacagtgagccaagattgtgccactgcactccagcttggttgacagagccagactcggactcaaaataaataaataaataacaataaataaataaataaagtggtgtagctactgtggaaaagtttcgtgattcttcaatatgtaaaatgtagaattaccatatgatccagcaattctacgcctagatatagatgccaaagaactgaaaacaggtgttcaaacaaaaacttgtacacaaatgtttatagcagcaatattcataatagccaaaaggtagaaacaagcccatatatccatcatttgatgaatggataaaggaaatgtctcatatacatatgtataatggaatattatttagccataaggagaaatgaagcactaacacatgcaacaatggagatgaacctcagaaacattacactaagtgaaaaaagccagacacagaggccacaaattgtgttactccatttatataaaatattcagaataggaaaatccatagagacataaagcaaattagtgattgccagagggagacaggagtggggagtgattgcttaatgggtatgggatttccttttggagtgatgaaaatgttgtggaactagatagtggtgactgctgtacaacattgtgaaagtatactgaaagtcactggattgtatacttcaaaatggcaaagtttaaatattaaaaaacctaaagtaaacaaagtgtttttcaaatatatcagtcagtaaccaaaccaaacatccttcatgtatttacatgaagtatctccacaacaacagtgatatcattaatatcagtgataatcatagataatgataacgtactcattatgcacaaggtgctattctaagagttttgcatggatttgcccatttaatcatcatgacgactctctgaaataatcttcatatttttattttaatatgagaaaaccaagacacagaaagtttatgacttatataacatcacatacatggttaataagagatttgattctaattggtctgtttccgaagccaaagctcttacccagtacattgtattgtctctgcagcaaaaaatggaaacaaatagatacttcttggacctgatttttttattagaagatgttaagaaaattatacaacagaatctgtatcaccattgtctttttttttagaatttttaaaatatactttaagttctgggacacgtgtgcagaatgtgcaggtttgttacataggtatacacatgccatggtggtttgctgcacccatcaacccgtcacctacattaggtatttctcctaatgctatccttcccctagcccccaccacccaacaggccctggtgtgtgttgttcccctccctgtgtccatgtgttctcattgttcaactcctgcttatgcgtgagaacatgtggtgtttggttttctgtttctctgtttgtttgctgagaataatggtttccagcatcatccatgtccctgcaaaggacgtgaactcatccttttttgtggctgcagagtattccatggtgtatatgtgccacattttcttcatccagtctgtcattgatgggcatttgtgttggttccaagtctttgctattgtgaatagtgctgcagtaaacatacatgtgcatgtgtctttatagtagaatcatttataatcctttgggtatatacccagtaatgggattgctgggtcaaatggtatttctggttctagatccttgaggaatcgccacactgtcttccatgatggttgacgtaatttacactcccaccaacagtgtaaaagccttcctatttctccacatcctctccagcatctattgtttcctgactgtttaatgatcaccattctaactggcttgagatggtgtctcattgtggttttgatttgcatttctctaatgaccagtgatgatgagctttttttcatatgttcattggccacataaatgttttctttgagaagtgtctgttcatatccttcatccgctttttgatggggttgtttttttcttgtaaatttgttttagttccttgtagattctggatattagccctttgtcagatggatagatagttttctatagctaggaaaaaagtttctttggaagaactgaaagctggcctatgccagatgttaacaaaatagcaatacatgctaggagttagttgtttattatgtcctctacacagtcctcattggttttgtgtttacctctgataatagttgctatatacatatttcagaaatttgcaaactgttttgtttttctcaacatattctatcaagtgtttttttttttcatctcttgaactgagatagaaatttgagaatgaaaatggttggtttttggaattttaggagagtattttaaaagtcagtttcctgaaagctgtttaggcaaacatttataaaaggcaaaatataattaacaaagaataatttcaaaaaatattatgcaaggtaaaagatgtctaaagtctgaataaagagtattaaaacactctttccgatcataaagaacaactttggtgatataaaaaagctgtttctatttggtgatcgccttatacttcaagagggtctaatcagtcctttttgaaaccgacaccttcaatgtctcctaccctatctgaaaccaaaaaaggtaaaatgaaaattcatctcacccactagtctccagcctcttcccctccgttatttttcccctcattgaaatgtaagtgagggagggctggaactgattcttctctgtcagtgcttagaacagtacttagcaaacatagatatttgacacattttgaatgagcaaatgcacgcatacatgaataaatgaatttaccaatttctttgagtctgttatttctgcaaattatatatttatgtatatgtatatattaacatataatctatagattatatgttctttacataaaatatctactcaatccatttccaaataattttaaacatcacaaataaaattaaaagagaaataatgacataaaaaaattcacaagtatccttaatatagagtacgctattggaaaacagaagggaaaatactaatactttaatcaaattagaaaataatagaaatagatttctgctaagtataattaataaaaattttaaaagttccacgtcactaatttataaaaatacacaagtggaattaataggagataccattttcttacttaaaatatttgtaaaatctttaaatcataatgttcaattccatagaggaatgatgaagtaaggtatatcaagtgaaatatataccatcatatgctgatggctgttaggactttaaattggtatagcatttggaggaaataatttagcaatgtgaatcaatagtttcaaaaataatcttactcttgctctcataattttacttctagaattctagtatgagaaattatgatacaaatatgcaaccataaacaaaagaatgaaaaatctctttaagtactgatctagaaataactgtatattaagtggagaaagcaaaatatgtatgatgtatattgtatgctaccttttttggcaaaaaaggacaggataattacatatattcatcttcacctatatactgaaaggtaaaatataaaagattatatatattaataacaatgttacctgtggggtagatgaggtggaagtggataaataagaccatggacgggagcaagatttttcactgtctacactttgtttatataaaaacaacttataagacaaacaaaggtattatctactcaaaaattaaatattaaaaactattaatagaaaaaagtgggatttgtagaaatgcatgttttcaggttgaagggaggaaaaatatataaatgcttttgtttgtgggatgttgtcataattatgtttgggttaaaagaaaattagaaatgtacacaaatacttattggaagctagctatatacattacactgtttttttacattgactgaatattggaagcattccaaatactttgatatattcacataataaaagaccattgaagttaaaatgatgttgtaaaataatacataaaatggtattaaatatatggaaatgcattcatggtatgttaaggtagggcatggatagggaagcaaatgagatgatagtatgtaaagtaggaatctatatttttaaagtaaaaattttcaaagcatgcatacaagcttatatgtacatatagagaaagaactggaaggatattcacctattaatgatagtgcttttctcagggtagggggatgatgggtatgtttcctattatctttattctttaaagttcttcaaataaatactttatgaaacaaaaaccaaaattcctccgcttattaaaggcttagaatgggctatttattatattaagcattttgagcatagtctcttaaatttcttaaaatcacacaaggtaggtcttatgaaccattttacagatggaaaatctgaggctcagagagattgagtaacttactcaacactgcacaactagtgtaagatgcaaaactcaaacgctggtctgtctgtctccaatgctatttctctatcaccctactaaataattcaacaaaaaaaccctgcttgcaattggaaaacatttttcctactagttttctttttaagtggcaaatcttttccttggttatcagaacttacatttttgtgaagtgtgctaaaatgctcaagaattccctgacagtaatttaaattaaactatcttgcatatgtgaattatttcatgtttttttacagtagataaaatatgctaatttgtgtaaatggtcttctgggtacagatgcttacactgaaagcaagcttatcttaaaagctgcttatctttcatttgaggcttctttatatgcatagtttatttttctaatgctgtctcaatataggaataattttaaggaggtatttgtggctaaatgaaagattaaaaaaaaaccaggtctcttggctttggtaaatattaatgagctcatagaaaatcttgttactgaagtgggccctcttttgagagttttctgccatcttggccctttgtgggcccttctcctttgttggggattagcatactgggttgtgtgtgctgttgtgagttctgcttcagttcctttgtgtgtgctgacagaaggctcaccttggtctattaccagaatagtctaggcatcttaatattatattggatttctgtgagaaaaaagcaaatcatccagaaataattaatctgacttattcatttaaaagctttaacacaaaatggacagtgttcatttcggtcatttatatattgtcatcattaacaaagtaaagtccaatgtttattaattttcaagtgaggagaagttcagaatttgaattatttttatcgatattcacacatatattgtatgtgcaaaattattacagcacatacacaacttgatttaggcactctgttttcctttagaccaagcatcatgttcacttgcctacagatttctaaaaattatttttagtttcataagcagtaatattttttaattgtgttaagaactcagagaaggtaatgttggcgctattattaccacattggtcatcctctaaaaacagtgttgtgaggttggtgttagatataaattgtgaatgatgattaagtacatttactgatttcattctactatatgcaatcctgaaatatgagaataggtatatttaacttgttaggtaatttaatgaaatatatttgctgatatcattctactatatacaatcctgacattatgtaagaagaaaaaaggcaattccactattgacaggatataggaatgatcaaaattacttaacataaattttgaaaaattaaatttcccatgcatattttaacttctccattagtccaacaggttgtatgatgcttataagggaattatttggcaaagaaatattttctttttaagaatgcagtatatgagtatagtcacaaggggtcataaattcacacccagtttttttaaaatgagcccattggattaaaaaaaatcagaaaaactaaagcagttgtttgaaaactttttttaggcaagaaaaaaatgcattaagcactttcaagagttattactgtcatcatacacttcttcatcttctttcatagaagttcaatataccagacatttttactgtcatgaagagagaaaaatgatagttcaagaatataacaagagtatttggaaacacagatagaagtgtcattagcccactattaagtctgtactgaaaaacgttctttaaattttgtgctcaatcatttgaataaaggatttaagtccttttataaaaactgtttttggaagaaattttataagaatttttatcagagccaattttgagctgaggttgtggctggtaatattcagttgttgataaatggagtgtgaatcctgagagaaaccacttcaatagtttgagaaagaaggagacaatttctgaaaatgatttcctaatctgagaaacagagctttcttctgagaaaagttttaataattttaaaaactacagaaatatggagtcatggtcacatatagccatttttccatagttgtatttgtggtgagttagaaaatagatatataataaaggtctggaaatgcaaacagtcaaatttaggtttgattattattagttttgagagaaagacagagaatagtacttaatataaactatcattatgttacttctaagtatgttcctttcaattcagctgtactagtaaaattttactttttttttttaataagggttaaaatcatggttgaaatctgaagcatagacttgatatattgctttcctatgctaaggttcctagccctggacactaattctaggaaaaatattgaaaagaggaaaagagctctcaaatattaaaactgcaccataaagttcaaaagtaatataaactttattttattttattttatttttttttttgagatggagtctcactctgtcgcccaggctggagtgcagtgacgggatctcggctcactgcaagctccacctcccgggttcacgccattctcctgcctcagcctcccaagtagctgggtctacaggcgcccgccactatgcccggctaattttttgtatttttagtagagacggggtttcaccgttttagccgggatggtctcgatctcctgacctcgtgatccgcccgcctcggcctcccaaattgctgggattacaggtgtgagccaccgcgcccggcctataaactttattttaaaagcttgactggtattaagaaagcctataataaaactcaaatgtatttttttaaaagatagctaatttcttcaatgaaattcaatatgatctgaatttttacttagacacagctttccaataacatattgtggtagtaagaatgctggtccttccaagatgtccacaccctaatctctggaacctgtgaatattaccttacatggctagagggatgttatatagttgtgatgaaagttaaggaccttaagatgaggagattatcctagattatttgggtgcgcccagtctaatcatatgagtccttaaaagcagagaaccttgctgtgatttaatcagacagagatgtgcctgaaaaaaagacacagagatacaacagtgctggctttgaagatgaaggaagacgaccacaagtcaaggattatgggcagactctagtaactagaaaagacaagaaaatggtttcttcccaaatgtcccagttaacacttagtccagtgagacctgtgttggacttatgtcatacagaacaccaaaataataaatttgtgtagtttaagccactaaatttgtgttgatttgttacaagagcaatagaaaattaatacacgcgatagtaggttgaataatgtccttccatatatgtccatatcctaattcccagaacctgtgaatgtttccttaaatggcaaaatggactttgcagatgtgagtaaggactttcagatcgggagattatcttgaattgtctaggtagaactggatgtagtcttaacagtctttataatacagacacaggggtggtccaagtcagaggagagggtgataagctgatgggaccagagactgaactttgaagatggaagtaggggccacaagccaagaaaaataggcagacaccagaagctgaaaaagtcaaggaaatagatgctgttttcagagactccagaaaaaaaatcagcttgaccacacttcaactttagatcattcaaatagagtttggacttctgacttccagagcaataagataataaattcgtgttgttttaagtgattacacttgttgaaatttgttacagcagccagaatacactaatagagacacatttatgatataaagtgaggtatatatatgcaagaggctgcatgggcataggatggatttttgattctttgaatagaaattttgctataagatcatagaagctatgttttcaggtaaaacccagtttactttaaaaaaattttttaattgacgtataaaattgtatgtatttaccatgtacaacatattgtttggaagtatatgtaccttgtggaatgactaaatctagctaattaacatatatattatcttacataattatcatgtttgtggcaagaacactttacatacactgtcttagctttttttcaagtatttacatctatattaagtgaatttaactttaaaaacttacaatgtagtagcttgtgagaaaatggcggtcatagttcacatctgtattttcacacattgagtaggcccctcccacatcagctctgggttttaccagataacttactttggctgatagaacagtgtcaaaaatggctcaagcaaaggcttaagaagtgcttttgcattcgacttgctctttcttgtcgctgataccctttttcactgtctgaagaaacctgagttagccttttagaggatgagataccttgtagagaggtcccagctaaggcccctaacgtgagagttttgctgtcatagaccatcaaaccccagccaaactggtacagactggaagaactactcactcaacccacaaaatcagaagtaagaaacgtttgtttttttcagccactaagttttgggatgatgtgtttctcagcaatagataaccactgtagtgcatttattttctcaggctgtaaggtgcatttcagacatgactgttcctccagcaatcataaggaggtagcattagctatcctatattagatttcttctgaatcatttgttgcctttggtttttcagggaggtgggctagaaattggactagggacttcctgggcatcctgaaactactgaaattgagtaccttgacttgtacttttcagaaccaatttttaaaaatctttatcctccagaatatatccaactaaaaaaattaggttagaaatatttttgtaaagtattttaccctttgaatagattctgaatgaaaaggagaatgtacttcttgctaaatgtctatatttgtataggcctatatgagtatggtagaagagaggttgtctaagcagccacctaacatgttttaatgctgcggaatatcatggctgatgggtgtcctgcagaggcagtgttacagcactgaggacatgcctcagaacatttccctaggcattctaacatgttcagagatggatatcatagtggttaaggctatggctgtggatatagactttcagccatccaattctggttccgctttttactaggttatttacttcaccacatggggacaataattgtacttattcattgggttgttatgaggctttaataagttaatgtacaacatttgtaggagttgctggctggttgttagtgctcaataaatgcctctcattgtatgtaccaggcgattttacccccacccagagtctgccttgctgtagctgtgctactgtcctatgttggagaggaggtgttacctcattgggacccttcagtcaggtggttgaagtcagagctttgtagaaaagaaactaaagatccatttgcttctgatgaaaacttactaccagaaaatttcctgaaaaattaaagaatatggatgcagtccctcctggtctctcagagagctgtatattaatctctagggctctgaaggaacagtttgaagacaacttggccagataacctctgaagtccccacaccccgccccaatgctgctctcaaattaccacctcatggctactcctctcatattaggaaggtgatatttatttccatggaaaacaacaaagttaactgactcctttgggaatggaaagaatgacaatgtttccttcaccatgaactcaatcaactaaaataaccattcacgcctcccagctgctttcaacttttcactaccaggaatttccctttacctcttgacagaggaactcctgcagttatcttctcctgtgaccgctcatgtttgcaggcaaatatattctccttcagaggagctgacataaaagtattttaaatcaaaatgggatttaatatcacttgttattaaaatacatttctggtgcctgttttaagggtttattttcttgccaaatagtttagtgtaaaaggagagaaaataagtaaatcttatactatctaaggttaaaaaatttacgttttgtgatcatgatgtttgtattgagaaagtatgtgtgtgtgtctgtgtctgtgtgtatagcctgtaatgtgtaaggatatgatagaaactatatcacccacgcatttcattctattgccttcatgcttagttatttgataaataactgtatctcttatggcctaatgtaaaataatgaatcaaatttccccagtgctgaaactagtcgaggccttttgggaatacttttcaaaccattaacgcattaatgtgctgctacctatgtgtcctgaaagggttactgtaggtttcaaaaagggtctaatttactagctaatggtatttttttcgtaagagtcacttggctttgcggaatcgaatttcatctttctgcttttgggttaattcaattgaatttccagcaaactacattgtttcattctcattgcagtcagtccctcatcttacaaaccattgtgttccaaaaactcatttgttatttggttatttggaacttagaggtagttttcaatagaaaaattaaagctacaaatgttgggtgtgttcccagaatagcccacagaagccaacttaacccatcatatgtccagtcctcatgctgctatccaacaaaaccaacatgaatagcagtgcctataaaggtagcgtgctttgccagatccaagctgggagtcccagagctcattcttctatagcagccctgtcagtaggagtgagaactttcctgtcttcattcctccaacctcaaaagaagcaaagtgagaacacagcccagccataaaccatcaacagtgactgtgattgtttgggccaggggttgggggtagaattactcagggacaggggactatgtaatagagcttaagcatcaagatagaggcagaggagaatgaagagtcaaaattgtttataagttgtcaggatgtagtgaggtcttagaatgaggagtagaaagattgacaactaggtgactgggtgagtgaagacctgaaactagattagatttaaaggcttctgccaccctctcttcccctttacaatttcagagtcagctacagattcaagttcacctaagtaggattgcttggtaaagagcaggcatttcactcactggaaggctttataagaaatagctcattttttctgccattttttttgcccctgaggctcttgctcgggtggaaggagggaggccaagggagaatctcaggagagcatgggagcagattagagtggtatgatagaggttctcaggcagagacaaaaaagggatctcaatcttggtgtgcctctgctcctatctctgttgttataatgggaaaagtttgaacgtcaaatggaagagaaagtgaacttctagaagaagggatgtcaatagaggagcctctcctgcatgtctactaggacagtatccacgtgtaataaagtcaaaccaaggtggtctttctggatttggcttttctgacagtttcctgagaattgtctcaggaggaaaggatgcagttctcaaatgtttctttggaggaagccatatacctgtctaaggaaaccattataatcttagaaatgagcttttgtaccagatgtaccacatatacaagattctcataggaggatccttgatgagcctttccttctcctgtcttgagtgctcttctcccctcatttaacccagttagttcctacacgcctcttagcatgcccatgtcatgtgctcacgaaaacctttcctgaacatgtttcccagtcaggctaggccagaccctgagatagaagcacactcaaagcatattttgctgctgcttttcattatttttactctctgtcacaatttgaagtacataactcattggggaactcctttttaaatggttgtcttccccttcaagaaaccatctccatcaagacagagactatgaattaaccactgtatccagtgcctagttcagtgcctaacacttagtaggtctttgtaaatatttgtcacgaactatcaagaagcagaaattttgtatcttaacatgtctttgtagggaggtcacctttaatgcatacctttgactattaagaaacttaagtagtgcacagagaagatgtagagaactgttaaataaaataaattgacttaaatgtatcattgcttagtataagggtggactctagacagcctttatatctcaagaaatttgcctacttctatgtcaaaattgtattagtacctatgaactttccaaactagttaatgctgttttgagttgaattggctttagaaattctaaagtggagagctgcccttggcttgctgcattgagcagactacagttcttaggtaggaggcaggaatggtcctgaggaacagtcagcatctctgccatccatgcaccacggtagtctagagcaactgagaaaaccagatgcctccatagaacccacaggtgtagacattaacaataggacactgtggatctttgtgttgatttcagccacccacccaagtcattaatttatagtttatgcccttcacaaaggaaatgtttttgctaacaaatctcttatgatttcatctatttgtcttttcctctttgtgttttgtctcatacaaataatagttaacatagtgacacaaacaccactaaaatacttcagtatttttctcaggacttattcattttacctggaaggaaattgccgtataacccatgccattagaaaattaaaaatgcaaccatttctgcagctcgtacgtcatatgctatgtaatgaaaacgtgcctagcctcctactcccttgtatttgccaacagaacttaagcaagttctgtctgggctgcactcacactttcttagtgccagggagatgattggatataaattacatagcttatatttcctaatatactaaaaagaaagggaaaaacagaaaaggaaggaagtaaaggaaggaaaaaaagaaaaggaaggaaggaaggaaggatctctaagtgtgtatcaccagaagcttagagagatgatattttaactgtagaaaattctcgaagattaatctactatatcatgattctttgaacttcaaagtatacccccaaaatataatatgtgaacagttgagtactattgcatatttcagtcaaaactaaaaacaataatctgtaactgaatatgtaacttagaaaatatcaatataaattttaatctaaatgatctgtttattcctttctcaaataatgacttcattttagtaatagagtgttttatttactcatataggcatacataaatagattttaagcattatttgtgatgaggcataaacatgaatcttctaatagaaagtggtaccttggggtaaattttattagggaaagatttcacttatgtgagctatcaaagtgatcaaattcatggaaacagaaggtagaatggtaattaccaggggctaggaggatggagaaaagaagagttgtttaatgtgtacatagtttcagatctgtgggaggaaaatgttctggagatctgtttacaaaaatatgagtatacttaacacttctgaactatacacttccaaatgcttaagatggtaaattttatgttgtgtgttttaatcacaattttcaaaaagaaaagaaatattcataagaaacttgaatattcttctagttttgcaaattatccttattgtttagcctcttaattgtatatcttacaaaaatctagatttagaatacaaaattattatgtgtattttatcatataaactcatttgagatgttaaatgatttagaaacactataaaattatagacagtttgtattcactttttcaaagttagttaaaacagtgttgatgtttctctgaatattgtcatgtttcataaaaacgttaatcttcagtaatttacatttattagaataatagtgtaaaacatgttatttacgatcattaaaagttagagtgttctaaccaattattactatttattgttgttattattattattagtttgagacaggatctcactttgtcatcccagctcaagtgcagtggcacaatctgcttactgcaatctctgcctcctgggcgcaagtgatctgctcaccttagcctcctgagtaactgggactacaggtgcatgccaccacacccaaataatttttgtattttttgtagagatggggttttgccatgttgcccaggctggtgttgaactcctgggctcaagtgatctacccaactcagcctcccaaatgctgggattacgagtgtgagccaccatgcctggccgtaaccaattattttaattaatataaataatcagagtataacaaaatacaccaaaactggttatattatctttataaaatatgttttataaatcactaacaaataactaatctggttggtgataaatatgtctgcttttacttattcctctccattttagtattgtaattttttagcattctatactagatcccatgtacagttgaagttttcttttgtttgttttccctgtcaggcttttaattaaagaataataagatcttatattattatagatcttatatcgcttatataactaaagagtacattcaaccaaactttaactgaactttacttgtttcatactggtggaaataagcacaatgtgaataacacctgagactgtcactggtggagagcgctcatgagcccagccctccttgggcttccttactggcctcccagccccacccttggcctgtgccatccttaatgtgaaatcccattacaccttacctaatctctcaaatggcacctatcagatcttctcttttattcttgagtattcagttcctcccttttttttttgatctttctaactgacatgtttacagccatttaagacacacagcacatgtacacatgtaacttccctcaaatccatgtgcttcttccattactctgtctcttttcttctttgcatagcaaaactgatctgtaccaattagtgaccgacatccttaatctagcagacaggttttagtctagttttctattgtccagatgatgttgcataatcaacaatgtcaaacttcaggggcaaacaattctgaagttaaataaagcactgcctagttcttgtacctgtgagttcgctccacccttgggctctgccctgctgtctctatttcttctggaactcaatggctagacaggcgtgtccttctcatgggaagagcagaagcacaagagggcaagtggaaatgctcagatcctacatgccatcaatttttcctttttcttttggctaaaacaagtcacttgaacaaaagaaactatactccactgatttttgtgggtgaaactgcaaagtcacacagtaaagaatgtggatatatgaagaggggaagaactggggccaagaacatcatctaccataataatcttacctacctttggagtagcaatgagtactataggcttttgccttctttaggaaataccctcttcctgtggcttccataatgaaacattgtcttgatttcctcccatccctctggctgcctttgtttagtttcctttgctggtccagctttctcaagacctggtaccaccatctcctcatctttttttttttttttttttaatatggcctctctacttagtgttatccatgattctggaactcattgccacccaaataaagctgaagcagagatgcttaaattgttcccttagtttcaaaaccatatatttaattacctattttatatttcttccaagatgtttcaaagacacctcagactcaacttaagcctaaatttaaatttaaaacatttataattattccctcttgtacccccagacttcttcagtgctccctagctcagtgaatcctactacatccattgagttatagaagccaaaaaaaaataagactcatcctcaacacttcttttctcattaagctctattgattttattgcctaaatagtcctggaatgtatctgcttctttctgtcactgtggtttctccctagtctaatccaccattctctctcacctgtagcattgtattatcttctgaacctcatctccttttgcccccatctgatctgttctctgcattggagccagaaaaatcttattgaaaagcacatctaataatgtctccttccttttaaaatacttcgaggactttccattgaatggatagaggtaaaatgcctgacagacctatatgcatttttgtccctgtctcatgccatgcttaaccgtattactttgcagttccgcaaaaaacatatcatgagacacagattttgtagggcatttatttggaatatgaggccaggaagtaggagtgagggaataaggagaatgaggaaaaaacaaaataacacaagcaaaagccattgtaagagtgtatgattgagtttgcctctctagggaacggtggtctgatttcatagcacatctagaaagtctgcagattaggacccataattatatgcctgaagaataagcacctagttgcatatatccactggctccccattgtttgagggttgcactcacttgtgtttagctcccctgcatttcagagccagacacgtgcacatcctccctgtctttgcctagttaactcctatttatttttctgaacccacctcattcctgtgacagaaaacccctgcctctaaatgaagcaggttcttccagttttctcaagaccacatgcctctactatacaccatatatatcttctttgcagtgctgattgctgtgatgagtttgcattttttaatgattatttcatgaaaatctttctgccctctggactgcaagcttgagaagaccaagtttcatgtcagcttttgattttcattgccttaccagcacccaacctaggacctggtacataaaatatgttcaatatattttcaacaaatgtgtaagtataggtgtgtgtgtattaatatgtgtgcatgcatgtatatttataaagggaaactttgaatttttagagcttaaatagattactatcaatatctaaaaaggttatcatttttaattcaaatttcatattctatttttacttattgctttcttttagtgcttacatagtcgaattataccagaggcatctgtttaaaaaaagtcatacggagaaaaaacagagaactcttgctttacattatcatgatttatctgacagcttatagtattggtggcacttttctgtagaaagttatcgctaggcagttgctttaataaaacagagatttttgagttaaaatgggtaatatcagaccataaaagacaatcctttacaatcctgccttattcagtagaagtcacattcgttagtgttgagcaatttgaggacttaggtacttacaaatatatatatatatccatcccctaaaacaccatgtccaaatttttgtttcatgaactgggaactgtgacttgataacaggaaatatgtggcaaaaatagatgagtgttcagtctctggggttttatgctgatataaaataataacaaccaaaatgggaatggagaggcagatggaaatcaacaaattatttttaatgaagtaaaatacttccataaaagtaagctaccagttggaagttatcactatttaataaatgttttttatatttctagttaccatgttgtatgccagatgatccagcattaattcaacaaataatatggtacccttggcaaatagaatggtcatcatggagatggacatagtctccaccttcaccgggatggttgttattgctttatttaaaaatgcagttattttctctgaaaacatctatacagatctatcatgtcctgagctttttctaatttcttggaagggaagccaaagtagcatgcatctaattcagtctcagacctcagcttccaagagatgttattaactgtggtgaaaggattagtaaaatagtaaatggattatgagatagttgtatctgtgtcaattagtggttgctgtcaattactagttgcttatattcactttctctcatttagggagtgtggagagtagaatattaaatgtctggtgggcacagagtctcttttcatctggtagttgtcttagttatacacggggctataaactgaaaatggtgtgtaaccctttaattgaagactctggggtcctaaaataatttcctcaagaacactctggcccatagaataaacattttgaaaaatattttctttggtttattgcatatttgaaatcagataatatctgtcactccaggatctataaactcttgcatgtgggatatttttaggtaaagtgatttttttttttttttgaggaataccaaggggatagtggatttccatgaacttaaggatcacagtttttgttaagccgaatacccaacttgaacaaattttctatttttttgttgttgcttattgacagatgtgccatgaaggtgtttttaaggtctcatgaccctaaaaatggcttacgataagcaaaagtaatgtcagctttgtcctgaggggatcttgattcacttatcagctgaaaacagctgagcaatcaaagcacaggttcttccttggtggaagtgacaactctagttcagaatcttccaatctgaatctaagatcatccttagaaattagggtgggtggagaaaccagagtgatgtgtgctggagccaatactccatcagagtgggagagtccactctttcctgttgctttccccactcaggccttgggctattttagatgaggtcaccttagccatgttctcaccactccagctttgggccatctctgatgagttcacctcagccatgttctcatcattcctcctctggggcatttcggatgaggttaccatggtgggcacatttcttgcctcatgtactttagaatgccatgtatgcttttaaaatcagagacaagtgcctaacaacttcttatttatatgtttttaggttagatgtaaaatgacctgagaactgcagccctcatgagcattggctacgtgaatttttgattaataaagtctagtaaattcattgactatatagccttatctaccaagaaaagataacttaatttttgaaaggattacttagcttgctttggagagggtcaaaatttagtagaaggtgtgtcaaatgaacattattgctgaagtaagtctgaaaaattcaaaactgttgatggtgagaactgaagtgtttattatattaccctgggtacttttctatgtctattttcctttggaggaaaacatagttctaagaatctaggaggcctgtggatgtatgaaattaagaggaaataaatattctatcaataggaagaacttcaagaaaacccaaattgtccatattctgaacataacatttgttatatgtgttatactcaatttagttgcttttgtttatctgagatttctgtagctttcaaaactgatctcttaagatttactagtaatgtgagttattaaggggggcaaaatttcattaattcattctgttttctaaatactttcccttatccttgcctctctcatgcagtctttcattgtttctctcccatttattttacaagaaaataaaaaatcttactgagacttttaggccttacatgatttggcatctccagtgaccagaaacatctcctgtctcaccattgcttactaaactccgtggcttccatcaattcctaaattatgtcaagcttttttttcatatctgaatcttgctttctgttccctctttctaggttactttttatgtatgttactccttcttctggtctgagcttaatcatgtcccctcctcagaatagtattgtctgaccacttttctaaattcaacatttcatcttatttttctcacagcatctgtttattgtcttcattgcatttgacataatttatgatttgtaaaaatgtgttggcttttctccttaggtagtgagcttcatgacagtaggaaccttatgtatcctgattattaattatatccctggtactaatagttagtttgacatatgggaggttatcacaaaaattataatgtatgaatttcaactgtaaattggaagcttgtcaagccccttcatggttagtgactgacctgttttcctcaatcttgatctaatgaggctttagactactgctcctagctttatgaaaatatttctaacaaataccatgagaacaaaaaaagacaatgtttaaattctgaatcttgacaatgttatactcttttataagtgatatgctttggctctgtgtccccactcagatatcaccttaaattgtaataatcccacgtgtcaacggtgggaccaggtggagataatgtttcccccatactgttctcgtgatagtgagtgagttctcgtgggatctgacggtcttataaggggcttccccttggctcttttctcattcttctctctcctgccaccatgtgaagaatgacatgtttgcttccctttccaccatgactgtaagtttcctgaggcctccccagccatgcagaagtcaattaaacttctttccattataaattacccaatctcagatatttcttcatagccgcatgagaatggactaatataatgtttattgcaaaagatgacatttttgaattaaatatctgaaagaaaataaaggtgtcttgtagagttttgtttccttcatttgttatcctaacataatagaaataaagaagtaatacaaagttttaggaaaacatagcaaatgaataatacagttatgactttaaaaggaaatcactttcagtaacagtaaattaaaatcttaattattatatttcacttctctatagcaaattgaaaaacaaaacaagcactgtgaaacaaattagaaattcagtcgtaatactctcaaatgtactaaggaatttagaagagtaaatttcatttagtttcaaaagattaaaaagtacaactttggacaataacgttatttttcttaggtaggcattaaagaaaatagatcccatatgtctctttttaaaagactgtatctaggccctggccccggaccctacagccatcaagatgttgatgcctaagaagaaccagattgccatttatgactcctttttaaggagggagtcatggtggccaaggacatccacatgcctaagcacctggagctgtcagacaagaatgtgtccaaccttcctgtcataaaggccatgcagtctctcaagtcccgaggctacgtgaaggcacagtttgcctggagacatttctactggtaccttcccaatgagggtatccagtatctccgtgattaccttcatctgcccccggagattgtgcctgccactctatgccgtagccgtccagggactggcaggcctcggcctaaaggtctgaagggtgagtgacctgcaagactcacaagagggaaagccgacagagatacctacagacggagtgctgtgccccctggtgccgacaagaaagccgaggctgggactgggtcagcaactgaattccagtttagaggcgaatttggtcatggacatggtcggccacctcaataaatttggagagggttattttgcattgtataaacatccagccaaaaaagcttaaaaaaaaaaaagaaaaaatctaaaccctcactgatttcagatttattaaaaaaataaacacaggtaatttccattttctagtgtctcctttgctgcgtatttcttttgtttaaccagaagatcacttgtgccactagatttatagaatattaagtgttactcacttcagtatttgtaatgtcattatccattttaggataatttcaacatttgtttattctggaaagcagaagtaatctgcattcagatacaatggcaattccatgcccagaatgcttccctgagcttcacggcttattaaagcatgcagtcctgtatttccacagccatactaagtagctggattcaggcctgtgaatttggtaatgctcagtacatttcaaaacgtggactgggattgaatatttaggtaagattgacttaaagataattagttcatatattataacagatgctttaaaggagtttgtgactgagcaaatccactgggggacccatgcactgtacagcattttaatagcttcccatggagctggtttttatccagctaggctttagtgtgctgccatctccttgtgtggagaggatttgagtctcactgtggatcctatcattggaattactctaagaatatcatagaaaatactgaggatctctttaggatttcagtatcagagatacttgttctcatccttagataagtactattaaagtagtttttattaggtaaacactgcaaatcttgaaattgatcatttttttctctctttaggttggcttctataactctaagaaccaaatatgggggcccacttataattgcagtatttcatggcatgtatctctgtatgaatccacctatgctctccatcttactctcctttttctatctcctttttcaagttcatattcaattcattgtaccttgcttaattatatgctttctgttaagctgacttgcgtgcctttttgaaatgaggtagattattaattcattaattactgtatagattgcttttctggctcattgtaattttcaagtcattagcacaacaggagaatttataaggtatttttgatatgccattagacgtatcaaaactagacattgggaaggtcttacactcttcatatgcttatgtaccttatatttgagttaattttcttaaataatttctactacataggaagctgctgaaaaattttaaagagtatttgatagcataactaatctagtacaaaaattaattaataatcttggaaaagacatcattaatgtttaggtagatattccatgccatcatttgcataacaatatcacattatgctttatcttcatattcaaagagttttcaacatacaaagagattctattataaaggtgtatttataagttagtcatttagaatgcagagttcattttcatgaacaatcaagtttctaaatgacagctaggttagcccataaaacctgttttgcccatagtatataagaaataattttaatttacagtgacaaattacagaaaatattattttacatcttaaaatagaaataaaagcacaaaaattaccttattttaattttgaaggctaagacaaaaatggtataattaggaaatcaggacgtagatacgcaggttcttgtagatgctggagagaaattctgggtatctttaaagggaggaggatttattgtactgtgtgatttcactccactgtatattagttgtcccttctttttataaatatatcattaatggtaggtgcttttctgattatcaaggaggattaagttccctttcaacttaaaaattaaatgagtaacagaggagaggagcagcaaaagacagagtaagtgaattggtattcctgagataaacagatgggagctggagcagaggcatctgagtaagggaagtgcttacctgggcattggacatgggagagattttctgaggtggctctaaatgagccataaactgctgaaatcatgagggtagagaggattcatgtgttgcacagaactcccaaggggaaaataacaactgcagatgaagggatatggatcacacaggtccccacgtttcctgtcgggctgggggcagggtggagtgagggcagggagggatcccgcgtagatggcaagttctttatttccaggtggtggcaagctgggtgtttgcaatcttggaagtgcttatacttataaaactttcacttactctgggggtatctgatactataagcatacagaaatgatgcagaattttattttaagtataaagttctgagcctggggccaggtacataggaaagtattaattaattttagttcttattattttctggcatttaatacaattgtcagtggaagttattaatactcactatttattattactgaacacagtcctctaaatcatgagttaagtaaatctaaaacaaaatacagagtactgtttccccatcactctgccccagctccatttaggaccttgttccctaacatgcaccatccaccaggccttttggttctttttaaccttttagtttcccttccttcacattattctgagttatctgctatccctcccagaaagtgaacatatgccctttaattactctgcctccattcaacgttttgaacctttcctcttcttccctttaccagccaacaactacaaacttaggtctccacttattattgtcacatttttactagcaatttacaacctcagctgttcaaaatcgagccctgattcgtcaacgttactgaaactgctattatggaagtgaccaaaactctcctttgtgcagaatttaatagtcttttctctgttcttgttctctttgatttttttgcagtattgcagtatcgaggctgttagccaccttcttctggagctcctcctcattgtttctctgagacctcctcatcgcacagctcagtctattgaaatcttgccctttcaggttccatcttagatgcctcctccttattggacccttcctgattctcccagctgccctcaataccattttgtctttgcctctattggaaagtctgttttcatctttgacatatagatatttgggtattgttaagatctctgctctggattctgagaatgaggttcttgggaataggaaattgccttacatttacttactgagtaaattcccaatcaacagttgctgaggactggctttctttctccatgcaacctcctgaaacattgccattgctgtacattattaatatttgagtcacgatatctatacctgaggtttaaaagctgacgaattgctcatttgattgccagcatcataccccgactggtgagtgtgctccatttttggtgaacacagaattttatacatttatttcagtgagtttactgccccttccttcaaagtagttctcacctaaacttgttttttattcccaagatccttattatgaaatagctgtttcagctcactggtatgcgagagcaagtctaatagcactgaatcctgacactggttctgtgttccagctctcactggttcctctcctggggtgctttttctctgactgcttttttaaggccaccaatctgaaatgcagtttccatttgacagagctgtagatgagcttactctgaaaacacactacttgcccttgggtctaaggtgctcatttgtagtccccgcacataaacctaggagctccttactttgcaatctgcaggtgctcagcctattgcatattggaaagaaatgttgtcaacaatgaaaacaagtcagtaaatacttaggcattttctcactagtaaattgctgcaatctgaatcatcaccatgttctcccaattcttttcccattccatactaggtagatttatgtgacatccctgaatatggcttctgctggtggctgctacctgaggtctgttctcctgccaccctctccgctcagggcctcggctggttcacatggcctcctgctggtgaggctgatcacttccttgcctgggacccttattaactctgcaaggtatccacagccttccccaagagagattggcagtcacttttatgcccgccagggtctgtgtcatgctttcagcacaaccctccacttattccgtcatgtagcatattagggattccctcctctcgaacttatctcctctcaagtgtctatacaagctaagaagacttactcaggagtggggtcatggtgtctcttcactgagtgacagattcttctttctcagctcctttgaaatagataagagctagtagtactgactcaatttataagatggcaaaaaactaagtaaataaaaccatgccaaatcaaaaacaaaaataaaacccacctaccctgatgtcttttaaagaagccttttgatcataggattggacattctctcacttacttactgagcatttatttctcaggtgtctacttagggtaaactccgcaaaagttcctggtaatgctttgcctatgtcagtgtggaacttggcctattaaatgacaggcagacaggccaggtgcagtggctcatgcctgtaatcctggcactttgggaggctgaggtgggtagattgcttgaggccaggagtttgagaccagcctgtgcaacatgacgaaactctgtctctactgaaaatgcaaaaattagccagatgtggctgtgggcatctgtagtcccagctactggggaggctgaggcacaaaaactgcttgaacccaggaggtagaggttgcggtgagctgagattgcgccactgcactccagcatgggagacagagcaagattccgtctcaaaaaacaaacaaacaaacaaacaaaaaacataaatgacagacaggtaagctaagcacagaacaatgtcagagtgcagttaccatcgagagcaggaaaataacagagaacagagaaagggggaaatgagcttcacaggatggggttaggaccaaagaaagtgatccaggaagtggatgttaaggaatgaatgaaaatgcagagaaaaggatgtaaaggagatctttgtgatatttatgcaagtcttctgtattttcaaaactccttctaaataaaaagttaccacctcaccaggccaataaagaggaagctaagagaaaggtattcacaacatacagtatgcaaaaaaacttgtcgctcatttggtgttactagaccttcagagtcacggggaaaccctggagacaaagctggtgtacatgcagttgaatctggatggatttggatttctaaaagggaaagacagaagagttctaattaatggaatggaatgatgtgattttctttttagaaaagtttctctctgtgactttgtggaaaataggtaagaggtcagggatgcatgtgaagggaccgtgatctaggtgaaaagtgatggaaatctgtatcaaggaggtggcaatatgactgacagtaaaagaagaagttcttgagatacttagaagatggaattaatagggcttagtcactgatgggatttaagagagaaggaaaaggatttaaagatttagacttatctggccagagtgattcaaattcatagaaaaagtaacctgtgagaaggagcaggttaaaaggaagaggaagggaaccacttctgttttgagcagcctgaatctgcactgcctatcggatagctgagagacggtgtctagtggcagctgtacatctaaaacccggacttgggggaaagatcacaatataacttagagatatagatttgaaagtcattaatagatttagactgtcttaccctggaatccatgaatagtcctaaggggttcacaaacctcagatatatgtatatactttccccttgggctaaggatctgcactgagtatttccagttgccttatcccacatgcatatatgtgcatgagatcacttatatcccttctctgtcctatgtctatctatgtccccaagaggctgatgtgtttgctggcattacccgactcccttgccatttcttatggtgaggcattggcaggagatgagagggaaggagaaggaaaaggttgggatattcttttcccgccttccccacattgggtcccatttctggcagaggctgtattcctccaggactatggtcctgtccagagtcccctccttcatggagccagcactcccaagcctgcagtaacacaaggccttcagtcccagcgggtcccactttttgctcttgccgtcctcttggtgatttgacatgcttttccagttgcctgaaacctgcccatacatcatgaggagtcccttcattatggtctttgtaccatctgaggtggattgtttcttgccagattccatgtgtctttttttggtgctctagtatacacttgtgggagaaaaaaactcttacaagctatggggacggctgaccacacccacagattgtggcccgtaaactacctgtgaggaccagcaagtaccttcatggatccttatttaccctaaaacagtttctaaaatcttagtgacaagaagttgttaccagacatcccaggtgaaactgcacccagtgagtattgtaccaaattcctaggactggcctcaagtactgctgagcttagaaggggaagagaatgtgagagttcagaatctatgaatgtgtccagcataaagagggctgaatgttacagtgatgccttcaatctaacctgaatgttcttcttgtatttttgatatttattttttttctccactttttgaggtggagagggggatcaggatggatggaatatttgatagacaaggaacccaggaatttctccaccctgtccagctaaaactatactgcttggcagagttcccaagacggcactgtgcaaacaatggcagtgaactggatatccaagtgctgccttaccagctgaaccggtacctagtgttccagcaaatacttcagttcaaaacttaagcagtgcctcctgccctctttaaatttgagaatacatatcaagcacctggagtgcaggttcttacattttaagaaacagtgaccccactcattagaaaatgtgattcaattagtagcttaggctctaaccagtcagattaacaactccattctctattccctccccgctttctctttctcccctacacccatccttactctctctgaggacacacaggagttggcagaaatgggtctggtatgaggagagggctgaaagctccctgtccctggactcgcctcagcttctcttctgccatattcctgccattttttttttcctactgactctcctcgctggcacacttttttcttcctgactttttgttgaaaacgaagcattagataacctgggggacaactgaccttgtatgcctatgtttacaacatgttgccacccataggtagccaagtcagtgattcatcaggagttagtagatagggtagctagtggtggtgagaatagaaccattcacctcttttctcttccagaggaatcagggggtaagatattagggttgaaagggaccctagggatcactgggtttaattttttttaacattttcaaaacgccttagaaacctgtatttaaataaaatctttaaaataaatcaacatatgaaacaggccttgttctggatgaagtaggttggaagtctgagtccacatgaaaacaccatggctccttcccattgtcactattgcgtggaggctcctgggaaccctgaatgcttcatgaagtccacctcgaaagccttcagttatgaaaaccttatgaaaacctgctgtaccacagacttaaaggacttgctcacagaagttaaatggcctagagaattggagagcctcctaaatctaggaagcagcaccttaatccacattacattgccttcctcttctctgccccttcaaatctacaacattggattcaggatcacacagctgacaccccattcacattgccctcacacttacgattcactagaaagctgtttatctcagaagacatttttatatttaaaatggtgtgtgtgtgtgtacactgaagagtgtagtcattataggtttattctcacgggtagtcggccaattctggacagggagtgctggcttacactgttagccaatgagtatctgaccatcgcccatgctatacttccctcatttagaatggcacccctaagttatttatttactctggcatggtccttctgtctgtgattgtaactgctctggcacacggttttgactattattagctgaaaaagagaatcccagtgatagtgctggaagtgctgataaagtgaacacttggtggtaaaaggcaattttatggcagcgccaggaagaaaaagagggtcaaattcacaaagcaattagagattggtggaagtcctttgagatatgagggatataaacctcactgaagccttgtaagattaaccaataattgtatggacaatatctggaaagaaaggaaaactattgctgaggcatatctccagttaatggctattgaaagaaaaagaaaaatggttgcttatgtttgatattgaagacaacatattcaaaatgactgtgctccaaggaatccatgtaggatagattaaattagtttgtcatctcaaggagcttgttcttaaagttaagtgttgtactcatttatcagtccaggtaaggatacagtaatcaacgcaaaagaaggcaagatctcttttttcttttgtgttgtcatatactcaaaacaattttcagctctattccaagtattggcttaaacaattctgattatatcagtttaactggactataaatgatacttaaatatttcccagtaagccgttggtataacatcataccaatgactggaattttctgatcttcatggttggtcacacagttagatgtgcgaacaaacattctcgtataagagcaaaggccaggcgtggtggcttacacttgtaatcccagcactttgggaggccaaagcaggagaagtgcttgaggccaggagttcaagaccagcctaggcaacataacaagatcccatctgtaccatcaataatcaatcaataatgtatttatttattagtccaaatgaaaagaaataaacacttcatttttttaatagtacagttctattatatttttaaaatatagttgccatggtcaacagttatccagaatccgacttggtataaaaggattaatttttttttgttttttgttttttaaggaaaaacactagctggaaccaactgtgtggacagtgaaaatgatgaaagactgagagaaactttagaaatgcaagtgagggagtaaggtgctaagaggcccttagaagtcttggcagatgaaagatactgagtgtcagtttgcctgaagacaatacatatataaacagaatgggtttgactcagattccaccatttattgctgtgcccctaggaacccactcagtcttactgagcctcagtttcttctttggttaaattggggtaaccatacttgtctaatttactttctttcttttttttaaaaaaaattatattttaagttctggagtacatatgcagaacctgcaggtttgtcacataggtatacacgtgtcatggtggtttgccgcacccatcaacctgtcatctacattaggtatttctcctaatgctatccgtcctctagtcccccaccccctgacaggccccggtgtgtgattttcccctccctgtgtccatgtgttctattgttcaactcccacttataagtgagaacatgcagtgtttggttttctgttcttgtattagtttggtgagaatgatggtttccagcatcatccatgtccctgcaaggacatgaactcatccttttttatggctgcatagtattccatggtgtatatgtgccacattttcttaatccagtctatcgttgttggacattttggttggttccaagtctttgctattgtgaatactgccgcaataaacatatgtgtgcatgtgtctttatagcagcatgatttataatcctttgtgtatatacccagtaatgggatggctgggtcaaatggtatttctggttctagatccttgaggaatcaccacactgtcttccacaatggctgaagtaatttacactcccaccagcagtgtaaaagccttcctatttctccacatcctctctagcatctgttgtttcctgactttttaatgatcgccattctaatttactttctagggttgctgcaggaacccagtggaatagagtatgtgaacatttcccaggaatttgggaattgatatcagttttatttccctgttctcagttggactgtgtgtaatcttaaagacccagccagatatgaacctttccctttttaacatttttaaagtttttatgggatctctttatggtgcctaggcttgtctcaagcacgtggcctcaagcaatcctcctgcctcagccttccaaagcactgggattacaggtatgagccactgtgcccgacctttcctctttttttttgagatggagtctcgctctgttgcccaggttggagggcagtggtgtgatctcggctcactgcagcctctgcctcccgggttcaagtgattctccttcctcagcctcccatgtagctgggattacaggcctgcactactgcatccagctaatcctttgctcttttaagagagtgtttgattgcacatattcctgagtgaacagccataaagatcagaaaattccagtaacaataactttttaaccaacaccttctaaagagcaccttgaatttatttctcaataaagaagaagtaaggaggttttgaaactcaagaaaaggataaaggaatgtttgagtttgattgagaccaggagacagagtttaagataattcttaatctattattaatagtgaggccttaggcctcatttaaaaaatgacctccttatagaatatgaggtggtacccttaagacctaaccattgatgagcttacaaaaagagatatgttttcccccatcggaaagcttccctctcagtgcagtttgaaaaatgaaggtctaccccagggtagtcatccttcatgtaacattaaatattaaattaaattggttggttgtagagccagtgttttctttgaattctttagtgtaaagaggtatttcttctggaatattttctggtagtgtatcttatttctttacccacctgtgatgtagaatctcttctgtcttggcaggaagagaaatttgtactacacttatttacttttggcaaagcagttcctattttaacacctacttgaaagtgttaagacttttattttattgttgttgtgagggggatgaattatttatacaaatttctccctttaaaccagaacaatgatacactgctctgtaaatatctgttggaaaggctttcagttttaactcatcatattgtaccgcacctatcaagtcctttactgggttttgcatcagagtcaaaacactcaaaaatgattcagggttctagatgacttcttagctgtaaaataagtttgcctttttctcaccattttggtgcaaccttacatacacatctggttgagatcattttcttgaagtcaattgaaacctattggaaacacacaagacatagcacaaatattgcatttttggagtacggctatgctgtgtgtcaaaaacctaaaatcatttatttctataattgagctcaaccatatgaaaaagtattagctacaagaagcaatcagcattatttatgacagagaaaacacagaaactaattaaatgtccaatgagttacccgaggaaatgttgaaaaaattcataagaactagctatttaaaatgatgctgtaaaaatatttatttaaaatatttattgacatgaaaatcatttcatgaaattctaaataaaagaaaaagattgcaaatagtatgaatatgtgatctaattttggtattaaaatatatattatttatttaaattgttaaaaatgcatagaaaatggtatgaaaggacacatacgaaaatgtgtttatctctgggtagtggaaatctaagtagtgtttactttttttttctttttgcctatttatttactattttgtgttttggattatgctgtggtgaacatatgttacttactgcataaaaagtaagaaaaactgttcaggatgatagacccatcttcaaataggggactacaggagagggaggtggtagaaattgaccattctgtagggggaccattctgattttaggatttctctttttagctttggtaaaaataaacaaaaaataaaactatgtcttaaaatataagtataaaaactgtgtttgttctatatgtttatactgaggttcaaatagctctcgtagatttacactttttgagtgactaatctctacatttttagtctaattttttcatttgctttttgaaccaatataggtgatattcacttctagaatattttatgatgatgtctgtatcacaaaataatagttaaatgcattgcgtgctgactagatctgactagattctaggcctattctaaatacttggcatgtatttacttgcctaattctcacaatatcctataaggcaggtactattattttctctattttacatctggatgaagaacctgaagcccacaggagctaagtctttattggaagttgtaaaacctgtggtagatctgggatttgaatcaagcaggctggctccagtgccatacaaatatgtgtcacatatgctacattatattttcatatttaccaaagatgttatgatggttaattttctgtgtcaacttgactagatcatagggtgcccagatatttggttaaatgttaactcttggtggctttatgatggtgtttctggatgagattagcattggaatcagcagactgcataaagctgattgccctctccaatatgggagggcattgtctgattgactgagggcctgaatagaacaaaaatgtagaggaagggagaattcactctttctgcctgatggcttgagctggaacatcagtcttctcctgttttgactggtactagacttatatcatcagccctccagttctcagaactacactactagcttcctgggtctctagtttgtaaatggcagatggagttttttaacctccataattacggtagccaatttctattggctttgcttctatggagaaccataacacagatttgatgaatgaaaatgctcatttaaaatgaaaggaaacttcaaacaccatattataattataactataaagtaggtaatatatttttaatagaagaacaaaaacacccaaagaattttattttcacaaatagcttgtaaagaggtttaaaattttaatttgtatttttttctctttttgttaatatgtgtgtgacacattttgtatgaatgtcacaatataccataccctaaaatacatcatttttgtgccactggttaatttaatatttcttttctttgtaatatttatccaaaaatacacacacacacacacacacacacacatatatatatatatttaaacatatatgtttatacttatcctatacacacacacgttatacttatcctacacacacacacacacacacacacacatacacatatggtgtatatatgtatgtgtatatatatatgtatatgtatgtgtgtttgtgtgtgtgtaggataagtaattctttttttcttttttgtatgtaacccataaaataattagaacgtgcaaactcactctgtgttttcaaaggtccaattcattatcacctcacaccttttcaggaaagacagttatcaaaagcatctcaaatttaggctttcactgtgtaatgtcaaagttcaaaaagcaggaaaagaaatttatgcttacaaacatctcatggtgcatgacattttaaaaagcgtccgccatcctagaaagagacaataaatgtttttacactttaatctttagactgttaaaaattttcacactaatttcctttcacaggcctaaaaatgtacttttccccctctaccattttttcccttatttatatcattttatgttggcctctttcttttcactttcttccattcttttatctctttcatttttctccttctaataactttttatccatactaataatatagatgaagatagtatatgtgtattagttcattttcacacagctgataaagacatacccgagactgggaagtttatataagaaagaggtttaactggacttacagtttcatggggccagggaagcctcacaatcatggtggaaggcaagaaggaccaagtcacatgttatgtggatggcagcaggcaaagagagagcttgtgcagggaaactcccgtttttaaaaccatcagatctcctgagactcactcactatcatgagaaaagcatgggaaagacctgcccccgtgattcagtcatcttccactgagtccctcccataacacgtgggaattatgggagctacaagatgagatttcggtggggacacagagccaaaccatagcagtacacaaaaggtgttgctaaagatttttaaacataaattgacaatacttttaatgacagtgagtcagtgctatttttcaagaataaaaagagaagcaatgccagatttcccccagtgacataaaagagaaaagtagttattccagaaaagattgtattccagtttctggtaaaagaaaaactgactaaaaagtggcttaaacaattttttctctttcttcatataacaagtccaaaggtaggcaatttctggtattactttagcaactccaagacatcagggtcgaggtcagtatgattctcctgacttttccatctagtggtgaagtggttgtttcagcttcagccatcacacccacattcaaggtaggatgaaagaaatcacatttatcaggacagaaaaatggcgctagaaatcccctgcaaatttctatatgagctcactgcctcacccatgctgcagggccaattctagctgcacaaaagactgagcagtatatttttgccactaaaattgccaactgaataataaatcaggtttcccttaaaagaaaatgaaaactgaatatctgatagatgtattactagatatttctatgcaataaattctcccaaaatctagtggtaagaagcaacaaacatttactatcaagcagtttctttttctttttgaaccctttgaccaacatctcatttcccctatttcccagcccctggtaaccaccttttcactctctgcttacttgagtttgagtttttagacttcacatataaatgaaatcatatatttgtctttctctgtctaatttctttcacttagcataatgtcctgcaggttctttcatgttgtcatgttatcacaaatgggaggattttctttattatggccaaataatattctattatgtatacatatataaatggatatagaaaataggatgtgtatatatgtcacatttgcctctttcatcacaatatgcctcaagtgatagagtgactcaccaaagggcttaactcacatctaatatatagttgacttcattgtacagtaagtctgacatcaagtatggtgcctgttttaatttgctagggctgccataataaagtaccacaaactgaatggcttaaagaacagaaaatcattctcacccatattaatgtgcacacagattgaagtgtccttatgtgatgtagctatacttactttttggtgtcaaacatcttaatgtcttttttaaaactatgagtcagtgagaactaccacctgataggaaagcatatttagattctttttcaaacaaatctcattgggtctaatatataatagttttacagattgtatgtcttatctttataatatacatttacttgattactggtgtttttatcccaaagttacagttctgtttgttatcatttgatattatcatagaggaatagcctttaaagaccttggaagtagagtattactgcaaggtttgaaagaaaaacggcagcattaaagagtgtcagctcttatatgtatatgctttttaggaacataaacttagaacattaaaactcttaggtcatacttgtcaataaatgatttttttctcaacagtactttataaccttttagaaatttgccaacaggtgacaatactccctaacagtctgctagaagtgtcagagctcaggatatctgctttttaattgccatattcaaggtctaattattttctctatattggggtaagagaactgtaatgaggaagtaaaatcattaaacaccagtgagtaagggaacagagtcttcttgaattctgatgtgaattagcttccccagcagagctttggctgtggataatttctatctgaatgtctccttctcagttatttgagaggacacataaaatataaaggaagactgctcaactcttgtggtctttaaagagaagggaagacaatggattaaaaggctattattacatctagacttatagactgttaatacttaagagtttattaacctcaaagtgtcaaaatgttctataaatgagtaagatactatgtaaatcaggctacacatatgataaaagttgtcattagaataagtggcctagaaatatataatactacacagttttcatactttttgaattcatagaatttagacactcagattcctttaaaaccaattttgctgctttatttattatttatcatattgcctttcacagttattcttttctgtaattctcagctgttttagaaaactaccacaattaccaaactgtctcaaaagcaaaatttgttgctgtagctactagaaggctaagaaatcacaaacatttgattctgtaagagtctatgtgtgtgcctgagtgtatctcatgcatggttttatgataaagcatgctaaataaattgtttatatttgtgtttgtgtgtatatgtttaccacttatgaaaagaacatacccaatggcagagattgaattaagtgctttctgcatgatctcatttttccttatgacaattcttgaatgaaggtattgtacacatttattagctaacgcggtgggcttagcaagtggctgtattagtccatttgtcttgctgtaaaggaatacctgaggcggggtaatttattttaaaaacaggtttattttggctcatggttctgtagactgtataagaagcatagtggtggcatctgtttctggtgagggcttgtagaagcttacaatcatggcagatggggaaggagagcaggtatttgacatgatgagagaggaagcaagagaaagagagggagtaccatattcttttttaacaaccaattcccacgtgaactagcacagcaagaactcactcattactgaggggaggacatcaagctattcatgagggattcacccccatgtctctaacacctcccaccaggtcacaccatcaacactgggggtcacatttcaacatgcgatttggaggggacaaacatccaaactacatcagtggtttagctgggatatgaacctaggtctgcctgtctctagagaccattcatgtaagtacatagaaaccatattcttccttgccactagaaaaaaccctctagcaatttttgccaatgttgattataaaaaattttatatggacccataaagaaaagagcaaattttgagcctctctgggaactgtgaaaaaaaaagatctgtcctcatatcaacctttgacaattcaaagagcaaacagaagattgggttacttctgtgatcacactgataattccagcaggcaaatcttagtcacaacaagtccctggagtccagccaatctggctgctttgatgctaggctcagtagaactgaaccaaatgtgcgtgggaaagagaagaaccagatattgccatgactgctcatcagtcaggatttcagagactgaagaatgcagactgaacaaacctgaacccatacaggaaaaatgaacatagtaggagcaaaccatcgccctctcatacagcatagggagggattttctggagccaaagagtgggtttggggtttcgtagtccaaagtctggactcaagggaacctcagataaccagtaaaaatgatcatccatatcttgggtctcctaacaacttgacatgagtagtttaatatgttgaaacttcagtttccacccttgcaaaatgaaagttatattgttctcttccaaggctgttggtgaggttgaatgagataaggttgatgaaaggaacctcaatacagtgcctgatacacaataatgacaataattatatcataatcacagtcataatcacaataatgccctttctagccacatatggcagagacattggtgcagtggtcctcaaacatacgggtcagatttgtcgctcaagtctgtgatctaatgacatgatgaacccattagatgcctccctatcatctggatattgttccttgctttttccaagatctttttgaagatgacaatatattttcataatatttcactattttaaaagctttctgttgagcataatatacatattggaatgtgcaagtatcagttatactgcttgatgaaattttaccagctggatgtttttgtagccagtacccagttgagaaacagaacactttctccagtcactatcctcccgcaatgaagtgtaccttgggctaatagataagttttgcctattttccaaatttaaataaatagagccatatactctgtatatgtttacacctcacttcttttagtcaagataatggttgtgagattcatagattcattcatgttttgcatgtagtcatgctttgttcttttttattgctatgtaatattctattgtgtgactataccacaatttatccattttcctattgacgggcatttgattagcttccagtttggggatattatgaatagagattctataaatattcttgcacatgtctttagtgtacaaatggaagcattcttgcatgcctaggtttgggactgctaggtcatagtatgcatatgtttagcatcttttcgaaagcaagggtatcattttacatttccaccagctgtgtactgggttgttttcaatgattattgtgtgttaggaatcattcttcctgcatcacggttatttttaaagcatccacctgagaaaaatgcagctctactaagggctggttcttgtggacattagatcccaccaagatggctgagagcaggacgtgccctatgatatgtgtatgtgttagaggctggaaagctatcagaaccatgtacctctgctgctgttttatggcttcatatattttggtggcagtccttaacagctgtggatttatttttctaatgtttgcttggaaactgaaatgagtttgaaagcagcccgattcatatagaccacacaagtaagaagaagcatattagataacacaaatatgggctagagtggcgccagagaacaaaaaagaaacaactaatgattaggtaactagtggacccaggcatgaaatttagtaatatgctgtttaaacataaaaggctaagaaaaacttgtttgaaattgtagaagtgtctgacagctagtgtaaggaatgtgtgagtttccacgctgacatcctcccataccaacagcagtttcaacttatcaggtggccttcaattttagcaatgaggagaaaaatgggtaataaatatgagatcttgtgttaattcaaaccattcacaaatctctttattttagggaaagtcacgctaaaaccacaaaccagcaggaagaagtaaaactttcaataatgggttgagcatcgactgagcttgaggcctgacacgctgcattcccattttatcctcaagccaggccagttgtgtgttttcaccaacatgtttcccacagattggtcccagagatgctaagtcacttgtcccaagttccaaaagtttgtgaatgacagagccattttcaaattgaggttgagctgattcctcactgcttcatgttgcgagagagaagtaatagggaagtagtatgatttggcagtaaacagcaggcaaactataaaacattatctgatggacgacacaaacgctctttacatctctgtcattgcgccctgtccggtaggagcagctgaatgccatttggctctttcaccttctgctatctcaggaaggcaagctgagcttagacaactccgtgcctttgttgtcccctcacctcatgtctgtattcatctctgttcccttatgttgtaattttctaaccttttcccctcccatccagtggccttatctgaaaaatgaatcctcaagttgtccacagctcttcactaagacccggtctagatccaaaatgaattcagaaggctctcagccagcggggcaatgtgtggaatttatggtagtttgggggcgtaatcttagtgcagacaagtttcctttgccttgttggaatcacatcggagccatcaaattatattgcttctcaagatgcagttaaagtgatttgggatgtgctcctctggctctcccacttgaagagctttactgtgaagcttgagcttaaggtagagatgagctggtaggcccaggtgaggaaagtggttagattccttgtgacatctggaatcagtacttgactgatagagttggacagtactttcatgatcaagcattccaaacacctcatttaatgagggaagctccaaaagtcaaatccaagaatgccaagttagggaggagtaagagctagaataaaaatctctcaatgcatggtacagtcctctttgcttttttaaaaaagttattgtaatctcacagatgagtaaaattaagcaaaatgaagctagctggtttaacaaacttcattgtagcatcaaccaaaaatgtgtgagtcagcattaaattgggccagatttggggtgggagaaaaaaatggtcagatttcttccaccaaaaggcatcattagatgtcttcattccaagctcagagtgtacatacagcaatttgctgctcacagcacgtccacagcaaattatttcccttcgtcaatcagaattgtggtcgtctaatttgccattctcaatactagtcacgctttcactctgtgtaaaaattcagattttcttctctcttcttagacacatggcaccttttacctgcaaaaggtaattgcagtgactgtattgacatgtaatgatatattcacgagctaatcacatttgcatttcctccgcttgctactgaaaagctgcaaaggagtccctgtcatcatgtgtaggtcctcttccagcccagcattcacagcaggctggcaacaccaggcattcagtcagcaggtcataatgactctaccgctttctattattcaaaatggaatttaactgggaacttcatattgtattgtacacttaacccagttttcttatttgttataggtttatattgttaagcagtatggtaaaaataaaattctatttaccaaattctccttaacagatggaatgtttaataggccaataaataataggttttaaaataacttactaatctttatattctccgtattcttaatatccttcttatctactccagaccttttattttaaaactttagaatatcttaaataattaccagtcaatatttattacatcattatattctgcatttagctttattgcttatattttaacaaatgtaataaagacaatggcatatgcagcttgtagtttgttgctatgagccaggccctgtgttaagcaattagaggatctaagtgagtcctcaccttaactgtgtgaagtagatatcactgtcctctttttacagatgaagaaactgaggttcagagaggttgaatcactctttcaatgccacacttaaaaaagtggtcaaaccaggagtgatggcgagtgcctatagtcccagcaactcaaaaggctgaggtgaaagggtcacttgataccgggaattcgagtccagtttgggcaacttaagagaccttgtttcaaaaaagcaaaaacaaaaataagtggtcaaattaggatttataatcagaactatctgacattaaagtgctcttaaaagtgaaaacacgactgggcgcagtggctcacacctgtaatcccagcactttgagaggccgaggcaggcggatcacctgaggtcaggggttcgagagcagcctgaccaacatggaaaaacgccatctctacaaaaaatacaaacttagtcgggcgtggtgacgcatgccggtaatcccagctactcgggaggctgaggcaggagaatcgcttgaacctgggaggcggaggttgcagtgagcagagagcactccattgcactccagcctgggcaacaagagtgaaactccgtctcaaaaaaaaaaaaaaaaagtgaaaactcattattctgcttttgaaatggagtgacctttcttccttgttccatattcacatggaccatttcatccacaggaaaagaagaggaaattataaataccatgattcataatttaattactagtgaattgatagatagtaatgaaacaaaagtatgagataacagagaggaatgagagtggtattagtcagtcaaaatctattcagatgccagcaatggaccgttttcacaaaatctaggatctttataaaaacttttttaaagatagctgaactttattgattcaaatactaaaacttttacaaagaaacttttttagttttattttatttttaattgacaaatagtaattttatttaaggggcatacagtgatattttgatacatgtatatattgtggaatgatcaaatcacagaactagcatatctatcacttcaaatatttatgatatttttgtggtaagaacattaaacatcgtctctgtttgctgttttgaaatatacaatacattactattgactataatcactttgctgctcaatagaacaccagaacttatttttctcagctgcaactttgtatccattggccagtaatagttccccctaccccgccccacctcaaacctctggtaaccaccaatctactccctacttctatgagttcaacttttaaaagtaacttttcatggaaatctttctaaaatattctataggcatttctgtatagcatttaaacagatgacctcaggacatgacttgaaaaatccaggatttcactacgtggtggaatagctctggtccgttttcatttgtcttgagctctgctctcctgatgtttactctcatgtctgaatccacttggttcttgccttagtgacttctcttccatctagtgtgctatggaccatataacacagagttgcaaaaaaatctgtgtatggagtgattgggattctgaaggaaaaccttacagaggaaagtggtacttcagttatagctttttggggtaccagacaagttttacaattttgaaatactgatttatttatatttcacattgttcactacatataaatgcacatgtaagaaaatgatggtaaatgtacatacagaaaaattaggcatagaagtgtacaaatgagaacccatatcaaggagcttcttggcagtcaaaccaaggcaaaaagaggcagatttagttatgatttttattatcatagaagataatgtataacagccgtgaaagagctcatagaaagcttcatgtatctttttttaaaaaaattccctaagtcagagctgtgttgtagtgggctaaaatttctttttctgtttttctttttcctttttttttgagacagagtcttgctctgtcacccaggctggagtgcagtggtgatctcagctcactgcaacctccgcctcccgggttcaagtgatcctcccacctcagcctcccgagtagctgggactacagtcatgtgccaccacgcccagataatttttgcatttttagtagagatggggtttcaccatgttggccaggctggtcttgaactcctgacctcaagtgatctgcctgatttggcctcccaaagtgctgggattataggcatgagctaccgtacccagcctaagatttcttcttggtgttgctttcactaaaaaaataatcattagcagtaataacaactgaacaattatattaaaatactgtggatcaaataatgaaatagagagttatgctccctagggccttaactatctattcagaaagcaaagataaaactttatacggctagccaattcaagttagtatatgttgtcattactgaatttatgtaaattttagatataacgttctaaccccagtttttcaacttcataactaagatatgtagttgaagattcctcaaatgcttacgaggacattaacatcacccaaatcagccaaaatatgtcatataccattgaattggacacccacatctaatgactggttaatgcagatatgaaaaggccagccccttcacctcaattcctgacaactgtaaagtgtatcccagtttcagagacctccacagggttggcggaggcctggtgatgaccgcctctctgcccaacttctccctctgcccagtcctgcttccctcacttccactgtagttgttaatctcaagatcactccctaataaatttcctgattttctgtactccagtctctatcccaggtgctgcttcccctaaaaagaacatgccgcattacaggtcactttgtgcaagccactaagaacactgttcaagggaagttacagtctaatttacaagacaaggcacagcagtgcatacacaggctgaggggcaaacaaacccttcagcttctgaatgctgttacctctcagaagccagggagattgctgagagttgggggagccaaggaaggcttctcagaggaagcatcttttaaatattttcttcttccacccaaagcacctatcttggaatgtcaaatgattcaacactactacttttccatgtgcgtttgtaaaagtatataacaatttgagggatcatgttcttatgctgtaatctttctaaatcctctttctaaatcctaatgatgtgtatgaataccatagaagtagcaatagctcacaaaggcctgcaagaaggtagttgtgtttcctgcatagaaccctgttcaattgctgcctttctcttaagattatcatgtagcttttcaccttaagaaattaatatgctgtcatctgactaaataatgcttttggctgaaatactggtcccaaacatctcttattttgttgtgtctaatattttaccatctctgctcagcataacttattctcctcataatttcactttttctctgcttacactaacacgtggttttaaaggaaatattgatgattcatggtgataatagtacgtactttaatgaggttctgccattcatcatgttgttacatccatgtattataacactgaattgtagtcacctgtactggtagtcttcagtttggtttccccagaagcagactctgagattttaaggatttgagggtaggtagtttattagggaggtaactccaagtaggagagaggaaaagtgaaataaggaagaaaagcccatcaataaatgtatattatcaagccacttacaactgtgagcaagtatagcttaatccaactaaggaactctggtgacccctgtagaatatgtacctccctttcccacctaaaggcaagggatctgggctacttttacccaactattgtcagtaatctcttaagaactgttcctcttagacattaagtcctgagcactctcagtttcccaagtgcttgagcaaagtaaattcttgaagtcagagaaagctcttaggcaaaataaataaaatgcaggtactagcagtcaggcctaagggctctgagatggtaaaggcagggggatgtgggtgatgtcctgaaacatcatctacactggctaattaagagaaaacacaggattgcaatcacattgcgtagactggatattctcttcctcgctcctacagtcaatcacgccccaatttctgctgatgccatttccctgctagctctggggactccctttcctttgctgtttttgctgtcttctagccacatatgtctgctttcttgcctgttaataccccaagagttcttgcctctgagcctttgttcaggacggagcttgggtccctttgctaaaatgtgtttttaccttgtatatttctattgcagtccttctccaagctcactttctctaagatacttcacacatctttctgctatagttggtggcacttcattttagcttcattttagcacttctcataatctgaccttttattaagtcgggttcatagacatctctgtttctcactcaattgtgaatttctgaggggcaggtgctggcatgcaattactgtggtacccactccagtgcttcacatgtagtagatatttgataaatgcttgttgaattaaattgaataatttaaatccaaattaggtcagaaaaggatggtgttttaagtgggggggggggggcaccagattcagttacctggatagggaaaacatacacttgaattttctaacagcttgcactcaagctgtcattaaaattaaagtcctttattagatgctttcattgttgccgaaataatactccctgtgccttggagcagtagatgtaacagcctctcttagttataattttgtgacatcaggcatcaagcagtcgggaaattgcgagagctggtaatataactttacatatagtatatcattacaaatgagaaaacagggcctgcgggcagggatgctctgtaacatatttttctgagaagaaagaaaactcaatggaataacagtaaattctgtaaaaaacattttctccttaaaaaaagacagtgcccatttagttatcctttaataatttcaattaacttctgcatggcagcatgctaaaagaaacaaattgcctctcagtcagaaaactgtctgtctctccctgtcagtctctcatgaacacacacaaacacacacacacccacacacacacgcatgcacacaactctaagagcaatcattttaggagtctgggctgactctgaacactgctccaggaattaagggcctagactgggcaaatcactctgtttactggaagtatccaccatttcctctcctgtttcccacccatttctatgtttgcacacttgtaagctaatctaatttaaacaagaaaaaaaaagcctttaatgggatgataaccagaaaaaatgttcccattgtgtttaaatgaattcaaatgaagtcatattttgagggaaggggagagggccagtccccctgggggacttggagtcaagacagacaactgtgggtaagctttactggcaagcctctttcaatctatttcatagcttacatacccccgctcctctgatgccccagcccaaacaatgatacacagtgtgtcaggaggctgtagtagcctaaaccccaaattactgtgacttaaagtcaacgtagtattatttttgcttcttattgttgtgtttttctgtttttattttcaatctcacctgagaaggaggcagaccaggggtaatctgggagatccatgatcattagggacctagactccttttatcatctttctctctgtatttgtcttccatcttcagtgttgcctcatggtcacagatgacttgctggagcaccatcaatcacctctttgttccaggaagaaaaaagggggagcaaggaaaaaagattaaaaggacaatgcttcttcagtacatcagcagcttactttctcttggccacctctatcaaaaaacaagaatggagaacatattttgatgaaaatgcatattataaaaagaagggaagaatggctatcaagtagacaaaacacacagacatacacaatattgcttctgtcagatccttatgtggattgggttgcaaaagagtagtgacagcatgctttaagtgcctaaaaagtctctgtaaattcccagttctcttgttgatagtgtttggttcactcagagaaagatagagagagagagagagagagagagagagagagaatatgagggaagaggcctgacattttcttgagaactgaaacctttcttttaagatggcttgcctttatcaccatccgaaattctaagcactggatatttgtaccagactctaaggtaggacagcacaaatcctttgttaacatgacttggtccttaactcttaatatccctatttcttccctgagggagagtttggctgggaaggacgcaagtatcattatttttcttctgctggccaaagttgtctctttgtgcattctcagctttcaaaagaaattgagctgaatccacttttaaactctaagggattcgttatcagaaaagaaaaaaaaaaagagagagagagatttgagttggctttgaaggaagtggagactaggaggtccaaggttgaactccttgctcttaaaagcaaaaactagagtgagtcttaggattgcagtgggctctgtgcaccagtatccatagcccttggagaggaatgcccacagtcttttgttgagatgatcacctatctcttcagaatctccaatctagaatttcccatttcactttttagtaagaatataaagttggatactgggtattcagattcctgtttctgctctctctgtaccctgaggcctccaaatacgtataaagaaagaggcaatgtggcagtataacagctaagataggagtggtaacatgcctgtgggatcctcagaacagccaccactgggaaattcaaatgatcataggcaatttctaaggaggtcaaggttgcaggcttaagtcttacatgaatcatttagctctagtacattcaccagccataagctatacacataatgatgatcattgctaccaagaatttatttatttctcatttttgatctgtcatgtacaatatgatctaaatgtaatagaccatttgattcaatattaaatgcctattaaagagatggtcagtttttaagttttaataactaatttgaagcttcttcatcaatcttctctcaattgccttttatattttaaatgatcgtttttgaaaggctttgtcattgaatatattgtaacgtgtgaaaaaaaaagtgtttatactaaatgtgacttatcctcaaaggtccacagaaaagaacatctgtcattgttaaagatcatgcagcctttttcctctgcctggggaaaagttcaaagttgacagtgagttcacttgaagagatgtaatatgaagtcagagcgaaggtaagttgacaggaccaggacaagcaagataaggtttaccaaggagtcttggcccctttcatctgttccatgatctcacctgaaacaaaatccttgttctgctttatcttcctatgtatccaggagatttaagtagtaactgaagctgtctgtagagtaagtacagtagacataacaccacacctcgttttccttttcatgccggggaagccatgttcccgtgttgagactacctttagtggggactttctattcctttccagaacaccatttacaagggaagagggagcagaattattcctctttacagtgcttggaggagattcagaaggtgatcttgttcggactataccttccttaagtattatttccctgaagaaatgctgcagagtctattctgtggcattcttggaccacaggattggaagcacttgattgggaataagacagcacatttctaagatctctttactatattttggcttttttactcactataaaacatttacctagagggctttctattaaatttagtccagcccattctctgacaggtaagtccaggcatcaaaaagtgtgtattttctaaatattgaagtaccattcagcctgtgaaaaataaagcaaatttgtactgatgtggaaagatgttccagtgcatattaagcaccaagaaatgaattagatttgaaagcattcataatattatccttttttaaaagtgggagttggtagatggatgagcagacacattagggcgacttgctgcagcctctggggataagcagtgtatgcagaaactttgatagtcaatttctttattaagaaggactgtggcccggtgcggtggctcacacctgtaattccagcactttgggaggccaaggcgggcggattgcttgagtccaagagttcaagagcagcctgggcaacatgttgaaaccacatctctactaaaaatataaaatattagccaggtgtgatggtgtgcacctgtattcccagctactccggaggctaaggtgggaggatcatcagagcttaggaggttgagggtgcagtgagccgagatgtagcctccagcctggggcaaccaaagtgagatcacatctcaaaaaaaaaaaaaaaaaaaagacttttaggaaagagaacattctgattatttacttttaagtagtttgacttaaaaaccatattaacagggtttatttgaaccctggaagatagtggaccatttttattttcttctttgtactttttgtatttaaaaaaaaattcctcaaactagtggtggtgtttttttttttttttttttttttgagacagactcttgctctgtcccccaggctggagtgcggtggtgcgatctcggcttactgcaatctccgcttcctgggttgaagcaattcccctgcctcagccccctgagtagctaggattacaggcactcaccacgatgcccggctaatttttgtatttttaatagagacggggtttcaccatgttggtcaggctggtctcgaactcctgacctcaggtgatctgcctgcctcggcctcccaaagttctgggattacaggcatgagccaccacgcctggtccccgtgttatttttaaaaggtatccttgctgtaatttttctttatattaaggattctattttagacttttatatatactattctaattcatccattaaaaatttaggcctatatcgaaacctgtaaatctcttaaataattattcaaccagaaaaaaaagttaaatgcaattaaactttgccatatgtgtatgatatgcctaaactaaatggtaataaaaccatccctggttttcattagttagatatgtgtactctcagggataaaagaaagaaataagatcattttgcagcctttctttgaatccagggcagccatccaagaggccaaaaacgtaacgcctggaaaaaataaattccttttaatcttgtggattaatcaggtagtgcaaattttttttttttttttttttttttttttttttgagatggagtttcactgttgttgcccaggctggagtgcaatggcaggatctcagctcactgcaacctccgcctcccaggttcatgcgattctcctgcctcagcttcctgagtagctgagattacaggaagtagccaccatgcctggctaatttttgtatttttagtagaagcgaggtttcactatgttagccaggttgttctcgaactcctgacctcaggtgatcctcctgagttggcctcccaaagtgctgggattacaggtgtgagccactgcacccggccaggtcctgcaaattctgatgcaaacttataaaccacccaccttgatttacattaggaatataactgtatttaccttcccaacattacataaatactatgatgagaaatcaaaattaaagtgctcaaaattgaaagaaaaaatgtagttttgaaataggaaaaccatataaaaatgaaatttagattgcattttctattagaaaaatgtaaatatgtaaatgattacttaggatgctaaaatatgcttttattcacttatatgcaaacaaacctaaacaacatatctaatatgtaaataataaaaccaaaattatcttctttatttcaattggcaacttttttctccttaagtgcatattttatataaacacttcttatttgtttagaaataaaaactgcatgtaaaattcttttattcatttttatagactgcaaatatgccatagccttctgtgagctcgataaatatcaggtgataatttggttcatttaaaaaaaaaacaaatattttacagcttttgtcagattttattgctttaggccaaaggtcaatccaaggcccagggcaaagtataggtagtgtgttttttgagtaggtatacattggaaggagttgctgaaaaggattatatgtcatatttcagaggtacttccataaaagggatgataaccaagctggcctgatgagccacaattgaagttgttccgttttataaaagagtacaccatttcccacagtaggactcctcaaatgaccttcaccaaggcagaggcatattgtgctgaggcttttcagggattaattaaggggctgtgaatagtgtaggctagacataattgtatgtgttttgtgtgcttgtaaagttacctgttatgcatccccttaccttgctcatataattaaaagtagactccaaagaccaaaatttaaagcagcccctgttcactaatcgccccatggacttttgcagagatagttccgttttgggaatgaatttgtaagtggagtttagaccacaaacactcaaaataatgctttcatctgctccactggttgaagttgcccccagcggtgttgcttctcctctgtacatttcctcaattgactttcaggttacctctctgtgcgagctctgggggtgccagagaaaggcagagaaaaagagagacctaagtgcttgaggcagaacatcgacagctaccagtacgtgttctcagctgcaggtttactcagctgttccaaaggacagagaggcagggcagccgcagggtctgctctagactattctttccctttgagaaaatgccctctgaaatttcacgtggctatatgcaatatctatatttggtctagagtattataaaaacgaactagtcctacattgtacaaaaaagctaatttaataattgagagtaatttttgtttaaatatactatgttgaatcatgcatctagacatttgagcttaagttttgagactcagtatgtactgcaagactgaagaaatgtatcacatctgtgctccaacgatccctgtgtctgcagagtgcttcgtggtttaggaagtgctttcacaagcacatttttggatacttacaaaagatgtgaggtttacagaggcgttattgagatttttcagttgagaacactaacacccaggatggaatagtgggataaaaacacagctatcagtgtcaagagacatggatactgcccctggttttacccatggccttttctggatatatatatttttttctctgggcctaattttcttcatgtggaacatgagaaaatggacaaaatagctataaaattttgagcatcctgaagtgatgaccttagacatgaatcaaagactcttgaatctcattatttccatgatcccctcaagttccacgggaccctcattaccacttgtaaattcagtatctactataatgaagaaattcgtatatgtaactgtaaatcaaaactggtataataaagcctttcaaaaagcatataaacaatgtataaatatgaatacactcctattttgttaatatatacatgcatttatattatatataattatattttttacttggtaaacatttcaaattagaatattctctaattttgaaatgttaataataatccatttattgattattgttgatgttgatatcattgaaaattttacaaaatctttttatattcccaataaagaatcctatctttctcaacattatgaacatttatcttacagttacataatgtttagaattaatgtatttatctcaaaacacttgagggtttttttaatgaaagatgcattatataacttgcctcatatcatgtatcatgcatttggtatttaacttagcgaactgtttgttatcatggaatggcggccactgtttctctttttatgcaatccattagaacattggattagcactaaattattctgtattaattgtgaatataagactgttagattagttctgaattgttctgtgttacttgtggatacacacacatattttaatacagaacatatatttcttctgaatccatttctctctcctacttgaccgtagtaaacatactctgcactccagtgtcagtgccaggttatttttgttctctaagattttaattgcattcattattttgggctcagtactggttaggaatagtcttcaaagattaaagctgtttatgtggatatgaaaaatcatttggtgatctgccgaaaccctcctgttcataagaggaagcttttctgtcaaaagaaagaatcagacacataaaacagattttctcaattgatatcacagctctatagagtcattaggctaaagcacctgcaccttgaaatgctttgattgcccagtgtgctgtgaggacctgggctgtcaccttgaatgctgatattcccttcctctgagttaaagtaacatcctagatttatcaccatattggaaattcatttaccaagttgattcagtttgttttccccactcagtgttgtcctagtcagcagatgggccccttatttattagaatggtgcggtcactgaattgtatccaccaagctctgctacttttgcagtggaaatgttagcagttttatttaccaatgcaaatatttaccgagaagctaccaaataaaagttattttggattttttttaaatgtctaattgtttatgcaatcatctactcaagaaacatttactgagcacctatttttacatgattctatcttgtttgtggcaaggaatacaaaggtaaataagaggaaacagcctggtctaatggagatgagggcactggagtactaaagacatgggttacaatttttccttagtcatttattaaccatctggcattatcttctactctgtcttccctgtacttgtgtgtgtgtgtgtgtaaagtgggaagaatatatctttatcaggttatagtgtgaattagaaattaaacatatatagtattcaataaaagcatagtggcagaataaacagttcttctcagcatcatggtagtatcaataagacccggactgtgtcctcaaaggagtgtacattttgttggtgtaatttatgagatgcctaacataaaaactctccaacttattcattacatagactgatacttcattttatctccccccaccatgccccccgccagcatattttctggctcatttgtccctttagttctcttctgtgtcatccagagtccagtcaggaaacaggaatcttagcagttatttcaattgaaaaaggttaacatagggaatcgattataccggggttggaaagctacaaagccaaaaagagacctgtgagccaacagcaatcctaaggatgggggaacaaattaaaagacattcgcgttatcagattccaaaagctcgaagaaaagacccccaaaacttaggctgagacctccacccagctggggctgataactcacaggctgcaggagggtcccagtacagccatccttctcaagctgctatctctaaggtacaatgagaattgcaccgacagtgccaaaaacagtagaagatagaagatgaggctgactgctgctgctggagggaagagctatggccggggcttctctgacagtaatgatgggtgaaaaaggaaggagtaggtcttctcctgcctgccagtttcataccagtgtcctatggcagaatctaacagggagccagctgtgaagaggaggtgtagcttcatggtcccaggtgcagcatcacagagccaggaatagaaagggattggggcttacttactaactagcacaggtctgttttagcagggtgactttatgtccagatttgcaggattacaatttaccctcaaagactggagaactcactggctcctttcatttcgtctactatgatatgttcacttttgaagagaccccaatccacatgaatgttgaaagtaaacatttgtagttatatactcaaattatcttttgaaaagaatggatctgacttttcctacttactatgtcaccattgaagactaccttctcaaaagacttctgttgttactttaaaattcttaaaagacaaatcttcatgtaattctgttggtatcaacaagggaaacacctaatgtgggaaattaacttgtcattcttctccagttaaaatggttagaaatatgaccattaccattaggaaattgtatatgaggttaaacatttattaaatgcaaacacttttccaataaatttaaaataagagatatttctcgttttttttctggtttcaactgaaatagaagatgacatagcctctgtaagaagatgtagaagatgaattttggtatttacaagtttgcatgttgttgaataaaggtttatattaggtttcataattaattctaatattcaaatatctgtttgtagagcattttaattagtttaacaaatgtttactggggtcttataagtgccaggcactgaggaatcaaagttaacaagaccgccaaggtctcagcatgcagggagcacatattctagtggagacaagtagaaaaacagcaattaaacacagaaacaatgtaaaagtgcacaaagggaaaaaaactgagttattttggggagtgtgtttgtataagtagccatgaaagtcttcttgaacagatgctatttaagatgagaactgaaggctgaaaaggaaggaggaggaggtacctatgtgaaatacagaggaaataggaaagacaccattccttaagcagaatacaacttggcattttcaagataccgccatagaagctactggagccaatgcacagggagaggagagagaatgagtttgaagggattggaggggccagaccgtgaaggaccttgtagggcccagtaaacagttgggattttattccaaccaaaatgggaaaccatggaatgttttaaatctgggagtcatgaaagctgatttatagttttaaaagtcactctgttgactgcagagaatggattttagaggttagaatagaaacagagagagtatgaggagaagaaagccaggatctagggaagagataaagatggtggtttgagatacacttcagaagtgaatcttgaaggactagcgagtaacttggacatgagcatgggtaggaaaatgggagtggggaaaggatttacgaatgcttcctatggattagaataagcaactgggtagatgttgatgtcattatgaatctggtagaaacaaagagaggaatagatacctgaaagagtggaagaaaagtgaatcttattttagacacataggatgtttgagacatctgtgaaatattcaagtgcaaatattaaatagacagttgaatatccaagtttggaaattacagcaggaggcaaggccagtgataggaattagtaagttatttatttttgttttcgtttttttaaaaatcatcaaccatgtatctggatatgttcacttgcagagagaatctgcatagtaaagagaacatccagcattgtaaagactggaatagtaggagtgacaaataaattcagcagagaggtcagaaggaaagcaggagtcaagtcctgtgaaaaccaggagagacgattggtgcatgaataaaggagccaagtgtatcttgtgggagccaatcgaacttgcagagaagtccaagtagatcaagagacagaagtgtccattagatttggccacatggagatttccattgaccttgacatgaacagttccacattatatgaagttttatgagcctatatatattcagtttttatgagcctcaggtggttgataggaaggaataataatcacgacaacttttgtcaagtctgaggaagaactgtctgctgacttatcacattttcaattaggggataatatttgatgtaagtggctctgaaaggttttctgtctcctctctgattggaatccataacttgaaattgatccagtgtggtaacaagaatgctattctcctgtttgatctcttaggctttttcactgtagggcattcgctgaaaatgatgaccaagaattgtttaagtgcaaccaggctgggaaagccagtagtaaccaccgtaggacagacaagaggtacttcatctgaataaccataagaatgatagagcaatgtttttttcactcaatgtcaatttaaattacttgaactaaaaagtgaaatatagtttacttattcgaggatactctatagcagacaatctaatgtctgtggatgttattgaattacttccttatcggagggcaagctgaatttgtctgcagttattttcgtttataagagtacagcatttattttttcttaactgtgctcgactttttgttttgatggcaaaaagcattacttggaatgctgaattttaagtatagaattgtgcccttcatattctcacatacataactttgctttaccacatagagacctgatatgtatacatagctttaatatatatcttgtgtattcagctttaccaaatttgtgaacttttcttattttaaatctggttttaaaatttttgaaggggcattctagtgttgctttctcccaacaaaccccagactgatgccttaaaaatttgtctcaagttacatatagaccacactttctcaacattttctcttagatatctcagatctaagatgtctggaacaagctcacactctttcttccataagccccctcctcttccattgtttcttatcacaatgtatagtatcaatgaggaggtgaagccaaaaatctcgattttatactctcccttgctaccataagcaattcattatcacagtctgtccgtgttactctcgcatctccttctctgtattcattgacttgacccctgctgagcccaaactaccatcactattcacctagactgttgcgatatccttctaaatggtctctatgtatttctttcaacccatttcctagaccgcagtcagaatgccgttttcaaaatccaaatcaagcatatcattcctccacttagtactcttcaatgaccggccattgcctttgggatcatgaccaaaattcttaacccagtctaccaagcttgcatgatctggctcctgcagttctctcctggctcaccttgtagcactctgtccccactctctctctccattactctgctccagacatactggccttcctttctggactatgccaagccccttcaccctcagcgcctttgtgcctgctgtcccatctgctaaggatgctcttcctctccgttctttctcacctagttaatgcttatttctacttttgactcctactcaaatgacatttcctcatgaagtcttccccaagccccgggttcagccctatccctttgtagcactggctgctttctttcacagcacatatagctgtagatttttattcctgcactgggatatgggctatgaaggatattttattaacatttgtttctaattgtacactaccaattccatggggacctggatgatgcctgctttacttgacctttgtattcccagtgcgtattgccagtagcgtaagagtgttcactaagcatttattgctggatgaatgaatgaatgaatgaatggtgtcgagaggactgcggagaaacataaggctgactctgcatcttattaccaagactggaaaaaacaatttaaagttcatatcctactgtgttaatagaactttctgtgtatgcaaaggtcagtacattttaagattaaagttgattttctatgaacttactatatatagattgaggtgtaattaataatgtcaggctatggggctctatggacaagtaattattttcagatatgttctacagcatttattattgttaccatcgataactgtaatagctagcattagtagcttgcaaaacccactcataaacctgatttcatttactttaaatggatttagtgtaaaattcaattggaaacagtgcttaagatatagatttgaggtaaatttaactttactataaatatactgaacaaaagtctaatttttttccctgtgtttttaaagtttcaatttttctataatttctcaacatggatttgtcttgataattttgcagcacaggtctggtttgggaagatcattgcttttctatttgtagctgaagtctctgccagaaaaaagtattcatcatgtgtgtaacatggtatgattggcagttatataattgatcagagagagactttttttgtctcatcactggatttcataagttgatggaaccttaatggttgtgtagctgctacccatatttcattagtgcatactacattatggacacacagtaaatattaactgtgttaattcaaatgtaatttataatttaggaagtaaattgatttctgtgtctttctgacaaatcctttcatttctttgaagtattgtttattttagtttgatgtataaatacagccacataaacaagaaaaggtaactctgtcaccttatgttttaataactttgaaataatgagacatttataagtatgctgagattttcctccaagttaatttttcattgtgatttgttttaaatctttctactaaaaactatcatattcagattttgtatgatgcaagaatgtgataatataaatcgggacagatttttctggagtaaaattcaactgtatatattgaaatatataacagttgtatacagtgaatatatattgaaatgtaacagttaatttaacattatttatgatatcttttaacattcttcctaacatacatttcctcttttagaaatttacctaaagtaaatcgttagagaaggggcccttgtagaattataaaaaaagttatgaaatacaataacttaatactattttatcctataaagatttcttatttgtataaatatacttctgatgagattttgattttgaagaaattaagtcatttttccctttgtatcccaaatcaacttgatgaagcccttacttattaacattttaatttgagaaatcccagcacaatcttactattaaaataataagagatagtaattttgattgtcattgtgacctttttaaacaggagctaaagcacaccaattggatagtttatgcaaattgtaatgttttcttttaagaaagtgcttaaaattatgtttcaaaggtttttatactcactttaatcttagcatagatgatgttgagttctgcattaacgaggaaagtatcaccttaattatgtaatagggtaacataacatcattagataaaggcaaaaataggcatggcattgccgctaatgtgtttaagtttaaaataataatttagatgtctttgtgtgtttccttagaagttgctctgaggagatagtatgctctgcttcttggccagcttctggggaggactggctctcacattaagtatattaggtaacagtacaaagcaccaggacacatctatataattgcagagaccttacttgctgggttggaatctcacttggggccctgtttgttgatatatttgcaacaaaaagccattaacttacagggtcaagggttaatggaagaaatattcttgtcttcctattatcttgcaacgttttgctgggagctgaagaaagataacgcttttctctcccagtttctcctggcagttttaaaaatggtgacttcttgtttctgtgactaaataaaagattagatgccaatatggaaagctttagaattgtactcagtcaagctgacagttcagacaagtgttccatcacgaccacctttgctgaggtcactggatggtcccagtcacagaaactaggaggaaggcacctaaataatttcttgatttctatgacttcagttttttttttttcctgctccattttaggtaagttagtcatcttgcacaagaaggcgagaaaatttcataaaactttaaaggagagaacaaaaactactgctaagtccaaaaggaattctatgtctaaaagagagaatttagctaatcagattggtgcccctcaaattccaattattttagagtgtataaagagagtgaaataaatccttgtcccaaagaaattcttattcattaaaactatgttgatgattttaaatggaattatggattaaattagtttgcccagattttatgggtgaaaatcattgcctaccaaaggttatttctgtcatttttaaaaatacattacatagactaactgtttcattataacgtatctgatgagagtaggttgcccaatgcaatttaagagtcagtggaaggtcttttcttatatgtaagcgttccactgggaaattttttccggaaattccaccaattaggggattctccaggttaattaaaataagtcctttcaggttataataaaaatatcgctgagtactttagggaacttgtgaactcctttctgtttgaaggccggaatacctttataatttcatccggaggttagtcgtagccatgggtatagttaccactccagaattgtcttgaattgaaaaaatctcagcctatttaattgtagtgctctgccaacaaacacaggttgtgctggtttgatttgacacagcttggatggtgggtttgactaattttcctaattaaatctgccacaacagtcaatgcatgtggacacatatggttacagtcctccatttcacccataatttagcttgacaacacacatgtgagttttctctttactcaatgtttatacaaagggactttttagcacataattttctaattttcctgaaattctaacttcaaaataatacaagggagaaaatggaatcacaagtctgcttaatttaaaatgaagctggtggaaaacttttccctaattgggatatttgttttcttcccaaattagttgagatcatgctttatagcaggttagccagcatggctgataggctgataagccgtttcccctgcgcccctcagcagtgacagcgtgcttctctacagaaaagctactctgtgtctttgcaaaatgacccaagcctcagtcccttaagtccgtggaccataatcattagaccaatttgtccacttagcatctcatgtagtcaaagggcagattttgtatattcatttgtgcagactttgtatattcatacacctgttaaagatttcagcgttaatgtttttccccagagatttttttaagaccttcttctgtaatctgtttattttacatattctcacaccaggagttttttatacagtaatagctacaatggcaatatatattgaccttctgctaaggcatgtttctaaaatatctctcatcagaaaaaccaagcatatttggagtttccagggagagttttatgtatgctcaccagtaacctagtcaactgtgcagactgctgctatatggtggttactgttttggcttcatctgtggtgctagggtgactgaacttgatgatctctaatagccattccaactggacacctctactgttctatgaaaaaggaaagtgaaaggcaaaagcagaaatgcaggcaattgattaacaccgagcatcactgtactttcctttcacggcttccagtcctatttttctgattgttttcgttttgactttccaaaagatgaaattgtagaaacctctctcttaagtttcatccagaaaaggtacagggggtcaatatcagtgactttgaggacttcaacataattaattctagaaacatcaggaacatagcagaatttaattatatatgtctttatcaaattacagaacttgagtgtggctggcaagggcatctcggcccatcatcaaatgtgatgtcgcatgtgctgaactgagtggtgtgcctgcagaagaagcctgagacagcatgcctgagtttctttttaatgcatgatcatatgagcacctgctctactgtgcaaactgtttctaaccatagaaggcaggaatctagttcactagtgggagaattctgaggtaaaaattggagtgaagaaacttggatatggttttcacatgcttctgaacatctttacattaattgagtttttcttttatggctaaacgcttttattaaaggaagacttaaagatctagaatgacttgtcattgttaaattttcccttctgctatatagtttcagaaggaagttcagaagcattaaaactgtccctcttcttagcacacactgttgatacatgtgcttacacattcagtcacacatacgcaattatttcttttaatttagacatatctagtgtacatgctgagtgtgcctataagtgttaattataacaatatttttgaaataaaaatatataatatgcataccttctatgaagtaaataatgatgaggcaaaataataattgttccatctgatatcttcgtaaatttgtattacaaatgattatctctcgtgtgtctctgtctttggatctcatttctttgtatttctcttaacaagcacacacatacacacatacacacacacacacacacacacacacatccttggtgatttcaaaagaaataattggttttacagtttgtatctgcaaaagatttttttttcagttagaatatctcatttttaatgatagtattagagatatgcctaccattggcattctactatgattcaattttttattagtcatctttcacccgttgcttaacgtcaatggctctttcattcttagaccctgagttgaaatgaatttttacatatactcaatatggtttggggcccaccagttcccactacagtggtgctccccatcactcacatacaattttatttaagacaaaacagcagctccagcagaaaataagtgtaatcttctcctttgtaagttgtaattgaggttatggcacagcatattgcctgtggcagaatctattaccaagaagtggagaccatgatttgaagctggctgcagtgtaagcaaaatgaattaattatcagcagtacagaattgaagggaaatacagggtttcctaaagtgaaatatattggcatttttaaatagagaacactcactgcaaggaacttattgatgaatcaccaagtcttttctacttttcttgcctttcagaatttgtatatactcaggttaagatgactatgtgtaaattaaatcacactttgctcagaatgcatagaaatattttatagtatattttgttctttttcttagttgttgaaatggagtctcactctgttgcccaggctggagttcaatggtgcaatctcggctcactgcaacctctgcctcctgggttcaagtgattctccagcctcagcctcccgagtagctgggattacaggtgtgcaccaccacacctggctaatttttatatttttagtagagacggggtttcactacattgaccaggctggtctggaacccctgacctcaggcgattcacccaccttggcctcccaaagtgctgggattacaggcgtgagccacggcacctggcctgttctttattaatttaaagtttgcctatttttaacatataactgttactgtcacttggacaggtaaatgggcaaataatgaatggactaaattagcttcagtattattctttaatagaaaaataactctctccttatcaagtgtggctcaaagaaggcaaaatggaacgttttttgagagtttataaacatttataattttacgtcataagttgtgaactttagtgaccataacttttgttggtaattatttagcaaaattgagtatcttcatagcagcaagataattagcttatttgtatttctttatgtgtggttttccatttaatttaaatttcattcagttgactaacaatgatttttcacttttaaatatcaccattcaaaaaccaaatacaattacattttgccaaatttatttttaatttttttttctaggaataggtcgttatttggctgtttttatttttctgtttttagataattgtttcatataattgtaatgaaactgtttgcttttaagcttcatttagattcttttgtgaaaggatgctctgtctctactgggtattttctagcagttgtgcacattgacttttctttaagttgtagaggatctgagcagatggttttctcagcatctagacaaatagcatacatggttcaaggtcactccatgcaacctgcctatgataaattgggaatccagaatttgtctcatttacaaatgtccaacaacataggtccatggaaaacagtgaagtgccaaagaaaaagatcagcctcctgggaaggaggagacccatggaaaatccccctagtttcagaggctttcatgtgagagggctgtactgacctgtggtggggtcttctgatagtgcttctcccttctacctgccgttcagatgctctgaactgatgacctccatggaaactacaattaccaggaaagcctcctgttgccgtggtcactagtgactgtgcccatgctaatctttcccaatttcctttccagttgttttctagggatttctgtctttgatagaatgtaagagaagagatgaagaggtgtccaggtgtgtgtgtgtgtgtgcttttgtgtgtgtgtgtgtgagagagagagagagagagacagagagagagaaatgttgatgatgggtagtgaggtaaattctggtgcctcaacaatgagtttctacacagaaaaccacagttattaagttgatgtctgtggagctctatgaagtctttatgtgagcttcagtgggtccgtggatcctctaatattttgtgtgcatgcatatatgcctttttaggggagagagttcattgcttctaccagattctcaaagggaaatatgaaatttctcccaagaaaatcctacctcctgtggtataatggttgcccaaaatgttggttgctggatgctttctacttccttaaggaaaagttaagacgttttgtacctactttcaggcagtcctggcatgtatgggccatggattgaacattagaattcagtttaattgatcttacatttagagaaatttttccctagcctctggcaatgatttggctgttatcctttttacttattttcttttttacctctatttttccccagttttgtatttaggaccaggagaagacagttctatgagtaaccagctagacaccatattaaaagtagtctgttcatattaaatattgatcacatgaatgattgtaataatcatacatgcttaaagctgtatgtgcattaaccaaacctgtgtaaaaatttagcgaagctctgaaaggttaaagaatttgccaaaaaagacacagctggggagtaacagagccagggttcaaatctaggtctctgattttaaactccatgttctcaacactatgctattatgccagccatagtgggtgaacaaagcccaccagttttcacactctatccatacgtctaacaagactcatcttccgaacatttttttttcctctcctggcttttaagagcaatggcttagctagaaaaaagtgaaccctagcaagtgtttgctacccagttcacaaaggtaagaatttcaggttgtctgttaggtttaggttttcatagatagtcagatcctgaccactttctcttgtgtgacctcagacacataatctggcatctctttgcttctgttcctttgtgtctaaagtggggtcattgtgaagattcgatgagtttatacagataaagcattaaaaatagtgcctggtacatagtaagcactcactaaaagatagctgtcattattagttataacttagttggaaggtcttatttcctgagggcatctggtacgtctttggataaatgtggccatgaaaatgacagtgactcgaagagggccgaataggatcagctcagatctggagctcccagtgagaccaatgtagaaggcaggtgatttctgcatttccaactgaggtacccggttgatctcactgggactggttagacagtgggtgcagcccatggagggcgaccagaagcagggtggggcgttgcctcactgaagaagcacaaggggttggggaactctctcctctagccaagggaagtcttgagggacggtgctatccagcccagatactatgcttttcccatagtcttcacaacccacagaccaggagattacctcaggtgcctataccaccagggccctgggtttcaagccctaaactgggcggctgtttgggcacacatcaagctagctgcaggaattttctttttgtaccccactggcacctggaatgccagtgagactgaaccattcactcccctggaaagggggctgaagccagggagccaagtggtcttgctcagtggatcccacccccacggagaccagcaagctaatatccactggcttgaaattcttgctgccagcacaatagtctgaagttgacctgggatgctcgagcttggtgggggaggggcatccatcattactgaggcttgagtaggcggttttccccttcacactgtaaacaaagctgctgggaagttcgaactgggcagggcccaccgcagcactgcatagctgctgtagccagactgcctctctagatttctcctctctgggcagggcatctctgaaataaaggcagcagccccagccaggggcttatagataaaactctcatctccctgggacagagcacctgggagaaggagtggctgtaggcacagctttagcagacttaaacgttccttcctgcctgctctgaagagagtagcagatctcccagcacagtgctggagctctgccaagggacagactgcctcctcaagtgtgtccctgtcccctgtgcctcccaacggggagacacctcccagcaggggttgacagacacctcacacaggagagctctggctggcgtctagcaggtgcccctctgggacaaagcttccagaggaaggagcaggcagcaatctttactgttctgcagcctctgctggtaatatccaggcaaagaaggcctggagtctaacccaaaaaactccagaagacctacagaagaggggcctgactgttagaaggaaactaacaaacagaaagcaatatcatcaacatcaacaaaaaggatgaccatgcaaaaactccatccaaaggtcaccaacagcaaaggccaaaggtagataaacccacgaagatgaggaaaaacgagtgccaaaaggtgaaaattccaaaaaccacaatgcctcttctcctccaaaggatcagaactccttgccaataagggaacaaagctggatggaaaatgaatttgacaaattgacagaagtaggcttcagaaggtgagtaataacaaattcctctgagctaaaggagcatgtcctaacccaatggaaggaagctaagaaccttgataaaaggttagaggaacggctaagtagaataaccagtgtagagaagaacataaatgacctgatggagatgaaaaacacagcacaagaactttgtgaagcatacacaagtatcaatagctgaatcaataaagcagaagaaaggatatcagagattgaagatcaacttaatgaaataaagtgtgaagacaagattagagaaaaaaacaatgagaaaaaatgaacaaatcctctaagaaatatggaactatctgaaaagaccaaacctacgattgattggtgtacctgaaagtgatggggagaatggaaccaagttggaaaacacacttcaggatattatccaggagaacttccccaaccgagcaagacaggccaacattcaaattcaggaaatacagagaacattgcaaagatactcctcaagaagagtaacataattgtcagattcaccaaggttgaaatgaaggaaaaaatgttaagggcagccagagagaaaggtcgggttacccacaaagggaagcccatcagactaacagtggatctctcagcagaaactctacaatacagaagagagtgggggttgatattcaaaatttttaaagaaaataattttcaacccagaattttatatccagccaaactaagcttcataagtgaagaagaaataaaatcctttacagacaagcacatgctgagggattttgtcaccaccagacctgccttacaagagctcctgaaggaagcactaaatatggaaaggaaaaaccagtaccagccactgcaaaaacaacccaaaatgtaaagactattgacactatgaagaaactgcataaactaatgggcaaaataaccagctagcatgataatgacaggatcaaattcacacataacaatattaatcttaaatgtaaacaggctaaatgccccaattaaaagatataaactagcaaattggataaagagtcaagacccatcattgtgctatattcaggagacccatctcatgtgcaaagacacacataggctcaaaataaagggatggagcaagatttaccaagaaaatggaaagaaaaaaaaaaaagcaggggttgtaatcccagtttctgataaaagagactttaaaccagcaaagatcaaaaaagacaaagaagggcattacataatggtaaagggatcaatgcaacaagaagagctaactatcctaaatatatatgcacccaatacaggagcacccagattcataaagcaagttcttagagacctacaaagagacttagactcctacacaataatagtgggagactttaacaccccactgtcaatattagatcaacgagacagaaaattaacaaggatattcaggacttgaactcagctctggaccaagtggacctaatagacatctacagaattctccaccccaaatcaacagaatatacattcttctcagtaccacatagcacttattctaaaatcaaccgcataattggaagtaaaacactcctcagcaaaggcaaaagaacagaaattataacaaacagtttctcagaccacagtgcaatcaaattagaattcaggattaagaaactcactcaaaaccacacaattacatggaaactgaacaatctgcttctgaatgactactgggtaaataacgaaattaaggcagaaataaataagttctttgaaaccaatgagaacaaagatacagcataccagaatctctgggacacagctaaaacagtgtttagagggaaatttatagcactaaatgcccacaagagaaagcaggaaacacctaaaattgacaccctaacatcacaattaaaagaactagagaagcaagagcaaacaaattcaaaagctagcagaagacaagaaataaccaagatcagagcagaaatgaaggagaaagagacacaaaaaaactcttcaaaaaaatcaatgaatccaggagctcatttttttgaaaagattaacaaaatagactgctagccagactaaaaaagaagaaaagagagaagaatcaaatagacacaatgaaaaacaataaaggggatatcaccagtgatcccacagaaatacgaactaccattagagaatagtataaacacctctatgcaaataaactagaaaatctagaagaaatggataaattcctggacacatacactgcccccgcaagattaaaccaggaagaatttgaatccctgaatagaccaatatgaagttctgaaattgaggcaataattaatagcctaccaaccaaaaaaaggcccaggaccagacagattcacagctgaattctaccagaggtacaaagaggagccggtaccattccttctgaaactattccaaacaatagaaaaagaaagtctcctccctaagtcattgtataaggccagcatcatcctgataccaaaacctggcagagacacaacaacgacaaaataatttcaggccaatatccctgatgaactttgatgcgaaaatcctcaataaaatactggcaaaccaaatccaacagcatatcaaaaaacttatccaccatgatcaagtcggcttcatccctgggatgcaaggctggttcaacatatgaaaatcaataaacgtaatccatcacataaacagaaccattgacaaaaaccacatgattatctcaatagatacaggaaaagcctttgataaaattcaacaccccttcatgctaaaaactctcaataaactagatattgatggaatgtatctcaaaataataagagctatttatgaaaaacccacagccaatatcatactgaatgaacaaaagctggaagcattcccttcgaaaactggcacaagacaaggatgccctctctcaccactcctattcaacatagtattggaagttctggccagggcagtgagacaagagaaagaaatgaagggtattcaaataggaagagaggaagtcaaattatctctgtttgcagatgacatgattgtatatttagaaaaccccatcgtcagcccaaaaactccttaagctgataaggaacttcagcaaagtctcaggatacaaaatcaacatgaaaaaatcacaggcattcctatacaccaatagtagacaaacagagagccaattcacgagcaaactcccattcacaattgctacgaagagaataaaatacctagaaatacaacttacaagggatgtgaaggacctcttcaaggagaactacaaaccactgctcaaggaaataagagaggacacaaacaaatggaaaaacatttcatgctcatggataggaagaatcaatatcatgaaaatggccatactgcccaaagtaatttatagattcaatgctattcccatgaagctaccattggctttcttcacagaattagaaaaactactttaaatttcatatggaaacaaaaaagagcccatatagccaagtcaatcctaagcaaaaagaacgaagctggtggcatcacattacctgacttcaaagtatactacaaggctaccgtaaccaaaacagcatggtactggtaccaaaacagatatatagaccaatgaaacagaacataggcctcagaaataacaccacacatctacaaccacctgatctttcacaaacctcacaaaaacaagcaatggggaaaggattccctatttaataaatggtgttgggaaaactggctagctgtatgcagaaaactgaaactggaccccttccttacaccttttacaaaatcaactcaagatggattaaagatttaaatgtaaaccataaaaagccctagaggaaaacctaggcaatatcattcaggacataggcatgggcaaagacttcatgactaaagcaccaaaagcaatggcaacaaaagccaaaattgacaaatgggatctaattgaactaaagagcttctgcacagcaaaagaaactattatcagagtgaccaggcaacctacagaataggagaaaagttttgcaatccatccatctgacaaagggctaatatccagagtctacaaggaacttaaacaaatttacaagaaaaaaaacaaccccatcaaaaagtgggcaaaggatatgaatggacacttctcaaaagaagacatttgtgtggccaacgagcatatgaaaaaaagctcatcatcactggtcattagagaaatgcaaatcaaaaccacaatgagataccatcttgcgccagttagaatggcgatcattaaaaagtcaggaaacaacagatgctggagaggacgtggagacataggaacgctttacactgttcgtgggagtgtaagttacttcaaccattgtggaagacagtgtggtgattcctcaaggatctagaaccagaaataccatttgacccagccatcccattactgggtatatacccaaaggattgtaaatcattctactataaagacacatgcacacatatgtttattgcagcactattcacaattgcaaaggcttggaacccacccaaatgttcatcaatgttggactggataaagaaaatgtggtacatatacaccatggaatactatgcagccataaaaaagaatgagttcatgtggggacatgggtgaagctggaacccatcattctcagcaaactaacacaggaagagaaaaccaaacaccacatgttctcactcatgagtgggaattgaacaatggtaacatatgggcacagtgaggggaacatcacacaccagggcctgttgggaggtagggggcaaggggaggaatagcattaggagaaatacctaatgtaggtgacgggatgctaggtgcagcaaaccaccatgggacatgtatacctatgtaacaaacctgcacgttctgcacatgtatcccagaacttaaagtataataataaataaataaatataaaattacagtgattcactaataatcatattctgtgtctgaaattccttttcccctcctttatctttctgcacccctacagagataggaaaaaccaaagtgttttttctccgctcaaacatcactcaacacaacacttctcacaccagatgtatgggggtttctctccacacaccaagtgatcagttctctagcagacaccaagtgggtgtaattcacttcatttctgatgctggctacctggaggaagagtcaaccccacagattaaaagctcagtcccacaagactgcctcccacttcaaatgccagtagcaagccccaggttatgacctgtacttctgatgtgctggctatggatctaggtttccaaaacctccttctcaggttttatgaatttgctggagtggctcacagaacacagggacatgctttgcttacatttacccgtttattgcaaaggatattttaattttaatttttgtttttttttacagagttgatatgatttactaacaagtattaattgtcgatcttgagacttctgaaatattttcattggctttatattttaatatgaaaattaataatttcttttttttaaattttattttattttaagttccaggatacatgtacagggtgtgcaggtttgtttcataggtaaatgtgggccatggtgtttaactgcacctatcaacccatcacctaggtattaagccttacatgcattatctgtttatcctgatgctctcccccttcctctgcccccctcccaccccttcaggccccagtgtatgttgtttccctccctgtgtctatgtgttctcattgttcagctccccacttataagtgagaacatacagtgtttggttttctgtttcctgcattagtttgctgaggataatggcttctagattcatccatgtccctgcaaagggcatgatctcattcctttttatggctgcatagtattccatggtgtatatgtaccacattttctttacaaggatattttaaaggatacaaataaggagccagatggaggaggtgctcagggcaaggcatgtgggaaggggtgtggagtttccatgccctccctgagtgtgccactctccatatacctccatacattcatcaatctggaagctcattcaagcccagtcctttggggtttgtatagaagtttcattatgtaggtatgattgattacattattggccattggtgatccacttaaccttcagccttcctcccctccctcgatgttgtaggttggggctgaaggtgccaaccctctgatcatgtcttgacttttctggtgaccagcccccattctgaagctgtctaggggtttcatatccactgacaagctatctcattaaccagcaaccagctatctcattaacatacaaaatacactcttatcactccagaattccaaggcttttaggagctgtgtgccaggaaactggaagaaaaccaaataggtatttcttagtatacatcacaatatcatatccctgcagccacagcaactttgtagataatctttaaacatcagaatggagaaagtggaagatgagcccggacagagtgcattccaaatcagtgctgtttcgtgtctctctttttcaccgtataatctgaagtttagtctcaagattctgccatctcaccactacccatttctaaatggaaatttttcagctggtcacagccaggagccacatatgaagaggaataagagacagaagacttctaacttttcattgcttggcaacagtaaatgcttacagtttttttaaaaaataaaattgatgttataactttatggaaatcagttgtaaaagggagttagcagatattttatctttgtgataagacattctactggtctgtggatatgtgaatagtagatcgttttttggaagacactaaaaaaattaaagttttgtaataagagatgtaaattaaagtcatcagtagagagaaatgggtgccctaaaatatggaatatttggagttataatgccttctaaaggaggatatattattataaccatcatttattcaataaaaactataggtacttaccatgttccaggtacatggctaatttctggggcaacaaaaatgacaaagttattgtcatccttgcccttgaagtgctggttaaaggtgacagataatcaaagaaataattgcagagcgtggcactgagtatgatgataaaagttaaaaaaaagagtgctgagagaccacagaagaggaagctatcagctcttaagatgcttggaaaaataacagatgaaaggacatgcattgaacatttattgaatgaatgaatgaatgaatgaatgaatgagtgaatggtgtcaccaaagcttatgtcatcacagtgttaaacactatatcctgaaacaatgacctggaattttgcaaacaaaagagaagattcaatgtagtagtcaactccattgcagaacactggggcctcaaggtgagagaggaagctttatgactcctacagtcccctaaaaattgagtaacatattttaatctgttacccaataacatactttaaataatgtaagctgcatgctgttatttcctagaaagatgtggtttcctggagataagttgtgtctaggtgaagcttctgcatgatagcttatttcaactatgtaacaaagtatatattttaaagacagccagtagtgaatctttcggaaagaaaaaagttatcttaaaagtagatgcattttgatttaggattttgcatgtctgctttcataaataggttttcatatctggtttcctgcattaccaaatgacattgaagtttttatagatttaatatttatcataacatacaactacatctattccctggaattatgtgtgggtgtgtgtgtgtgtgcacgcacatgtgcatatttatctgccaacatctgaattccctctatagcattgcaaatgtaaaattagtatgtcattcttagaggtgctgtttagtattacaatctgtagctaaatactaggctaattattctgtgaataagtctctttctctggtataatgtagcactcaagcacaagcgatcaataaatgttattatgttatatattttaatgttattctacaagttagtaaataaaatatctaacatagtaacattttttgttttttatttttatttttaaaatatctaacataataacattgccaactcttttcacacatgagttcatgtaacccttatgatttgccatctacaaccatattttaaagtgccaaatataaagttggtcattgtttctaaaaagtcagtgttctcacgttctatttgactcttcgtgtctaatagtgatatttaaagtaggtcatttagctgctgattttactcctgaataactccggtccccttaacactatcagatgttcctttccatcacgtgtttttctgcttccagttgaagaacccacattaaaaggagttgagtggaaaatggaatgagcaatacgccctcagtttactattccttccagatatttttaaatgaaggtacggaaagataagatggtaggtttgttgcggggcagagggaggatggaaggagagtttatcaaaagcgaaaaaataaacagatgagggatataagaatcattcccacagcctccatctccctttatgttctctgatttccaaacatctgtatttctatttttaactttataatagcaaaaatgttgtttaagaagtaaataattcctaacattttaaggataaattagtgtagtatacccagtataaggcaagggcccagatccatgaaggtatcagcattaaagaagacaaattacagaagaccttcaaaagcctttagaagcttatgtactccttaacagtttacaaattgccttatctccatttttcatctgtataaattgatcacatttcctcaatttctaacatagagcagaaccactttcatattttttatttatatgtgtgtgttatactcatacatataaactgtatttttaaggacacatttaagtgttcccttttttcacctgacactaatgttaagaatggaaaattatgatacaattcagcaaggagaggaattgcggtgcatgttattattgactacattcaggtatagttggacaaattgggtaatggaaccaaattggattatatgagattctggccttaaaactatcattctattatgtcttctgatgaaacacaattgaatttgagttgtgtaaactgaaaaaaaaataaataattgcaaaatgtaaagtgaaagatacaagagtagctacatagaatcgaaataaaactactcacgtaaataaaatatttcttacacacttaaagcacatatattaacattatataagaacacatctaaatgaatgcttatcactgagcaatatgattttcaaaatgttattcgaagacaacttggctgttcataaatcttttaattttaagctgccgatttacagtttttcctttcatcctcttgttttgaaggcttgatgtgggagtgctaattaatgttagaattcttatccaatgtacttgttgctaagcagatagaactatcagagcattttattttgaaactgcactcttttttgactgatatagcatttgaaatcgtgcttgaagaaacatttcatggcagggagccagttttctcattaagaacatattgcccatgaccaattcactggtttatttatttccacaatgcctgttgcccctgtggctcatacatgcgtcgtgttgaaaaccacatgtaaaagacatgaacactaagttgtcttatcagtatgagaatacacaatttataaaatcataaaacatggaagttaatgaaaagtttatttagaactgtatattttgccttccaggcagaagttcttactgactccttgggctgtcttagctgattgcacgttgacttctgtattcttcatatacgttttttgtctcaatttgagtttcttcagaagcagttcctgtgtcagaggtcctgtttgtttggtttattttataagttcataaaatactgatagggatctgagaaatgagaaaggggacagcaactgagagaagccttggaaatggtttaaaaccatgtctcagagttaagggacaacggaggtaggatatttatgcaccaactcttcagtcactggctgagtgtcacaaggtttgaagaagatgtgatgtccctgacacttaccagcctgccatgcaaaaggacagagtagtctttgaagtttcagagaaagcactgagccaatgagaggcgatgacctgtactagcagttggatgccagttggggcacactgaagcagtaacagctaagtgctctaggtgggccaccaaaaacatctgccatatcttctgtgggcttacatccacccaaagtgttatttttattctatcctgatctatggaagatggaaggatcatttcgtagttgtgtattcatttttttcattagtttgtacacatttatggatatcccctgctggggccactgttctaggcatggaggcagacaccagggaagaatatgacacaccaccatcattgaggtccgcacagtcagggtaatgggcagaggcagtgaagagccacggaaaatccttgaggtgcaaatgaagttgaatcatttactccatctatgggaatcatttacttcgtctactatgagtagtacaaaatcctactaccttctggagtggctttggctctttgtctggcattgagtttctttctctgtcttagcccgctggtctctgagtacccccctgaagatgcattcatatagaaaagggaggagtcagtaatatcttgtttttctattcggggtattttagtaactgcatcctgtggctgaaacattcagatgatttcaagattttgacacatgaagattccaggttcacctatgaaagaaaatagggagtctgcctgccaaaattctagttttatctaaaggatgccaactagcatatagcatgcatgcagaagatggccagtattacattttttgaaggagtccattacaaaaactataatatttagggatatgtacttattaatctagaatgagagctacagctatggtaatatgaatggaagcataataatttttccaaatagtattactgtttagagattgtttttgtttctcttccttaggttttttttttttttttttttttttttgagagaggagatagaggtggctgctgtgatggcaatgatagctatggttactgtcttattgaatgcctattattatattaacaaaaccgaagttcagagaggttaattaacttgtctaaaatcacaagcttggctgggcatggtggctcatgcctgcaatcccagcactttgggaggccgaggtgggtggatcacttgaggtcaggagttcgaaaccagcctggccaacatgatgaaaccccatttctactaaaaatacagaaaaattgctgggtgtggtggcaggcatctgtaatcccagctacttgggaagctgaagcagtagaatcacttgaaccagggaggcagaggttgtagtgagccaagatcacacaactgcaccccagcctgggtgacagagcaagactctgcctcaaaaacaacaaaaaacaaaaacaaacaaaaaacccccaaaaaatcacaaactagtcagtcagtattttgacctgagtatcttgaattctcaggtgtggctgcaagacgtattgataagaaaaaaaaaaaaaaaaggtacaacataagagaattcaagtttcattcacttttccagcaaatattctgtagaaaatccactatggcccagccacttagctaggcaatgtgagtaccaccttctaagacagagaaacaaaaccttcccctcatacagcttaccatccggtagggaggttagctaagctattaaacagatcagtacataccgggggatgagtgttgtgatgggaaattcagttgataagagagcccgaagccagaagacctcattgattttagggatcagaaaaggctttctgcaggaagtaaattttaagctgaaagttaaaagaggatgactaagctaaagtgggagtcaggggagcggaaaggagagaagtgttctaggcactgggaaggcccagaggccttattctagcattgaaaggacaatgtggctgggacattgagttcaggagggagagtggagacagaagaagccgaggagatggaagccctgtgaaagatgcagcagatatcatgatgttgttcccaacctaaaagccctgggaagcccatgaaggagattcctctggctctggtgtgtgggcagattgaagaggaatataccaaatgaaaggaagcatcctaagtaattctgatgatcatcccggagtgctgctggtgaaggtggacagagtagatttctttgagagatactgaggacttaggaagagaagacttgggagagtttgcactgaagaagggagaaagcaatagcattgtctgtgcttttgatttgaaggaaagggtaaatgttagtgaaatagcttctgaaggcctttaagaagactgcctacatagaaagcctacttctatctgccggccaaagatctggaggaacctcatcctttcattctaaaaggagtcgtggatgtagatttaaccgttctggtatctgaaggtggtgggattaggaataatttttcttcctttttttttttttttttttgttttctctgctttagttttataattaaaaaggaattttcttataaaaatacagctactgtgatatcttctgctgaacatgtggctcaacttactcacaaggtcaggaaagttgggcccaaggcataactgcttaaactcaagaaaagagaaaagacaatttcatcaccagtgtaattaagtgagcttccctacaatatcttaacttagcttctcatctaagtaatatgaatccaggtatagtgggttttggtgtttattttaatcttgtattgtcattagccagttagttacattagttacccttgggtgtattgtggaaatagatttccgttacattctttttttcccccctttttaaggatttagagtattatgcctgagtgaattgattcatagggattttacttactcattcgttgtgcgctgctgtgtttttgttctccatctggttaagctgccgtgactctctgtatagcatttgcacagtgttcacatgatgcttgggtacttaggtgtcagtttttcattatgcccggatgatgtgcgttgcgtggaaagcctccggaaccgtaaactctcatttcccaatcatgaatagttaggaaaccagagttcggcattttcattaacatagggtcttacatgccagttcagcttactacctgctaagcctcctagtctgttggaaaatgtgcattggcagttttccagtcttgctaagactcataaatagatgcctttcatatgaaatgtatttgctttggcatattgacactggaatacattattcttttagcagttgaacaaattaaaataaaaatgatgacttctttttttcagtatactaaaatgagcataattgggttaatatcttaatctggcagtcaggaattagcttgtatacccacaaccacataatttcactaagggaagtttacatgtttccttttccttgttctgttgatgaccttcctacgtgtcaataactagcagagagtttggtcagataaaggggttggaataacctggagagcttaccaaaaaaaatccttatctctgagtaccatctctgtaaaatcctggtttaattggtcttgggttcagcctgagcacctggatttttttcaaagttcccagatgatttcaatgtgcagtcaaggctgagaacactcgctctcatcatgtgtaccagagacaatactttcgtaagcaaacagcctcacctaattgtttctttctcttttgttttccctaagtctagtccacatctttgggcatggtccttgagtaggagaataagagagctattgaatggtccaagaagattcagatggcttcattttacactccagttgatcatatagaagtttagggagaacactcaagaccactgggagctactatgtaggtgaatagatttgtccaagacccactctggcacttccaagctggccctggtgtactcatgagtaaagcctgccagtgtatacttacatttccaaagacttccgtttagtaagggctgcctgatcttataggtgcctcagactggtccttctacaagtatagttgttttatttcatacttctaaatggatgtttgatattgtttaggattcaaatgtttattcagaaatccataaagtaggtatttgacatctcatagttttgaacaaaatggtaagaacaagatatatcaaaatatatcttgaaggcatgagtaccatagaccttttagaagtgcattttctagcatcttgtacaaaacaagacccttatttctgtaaaacttgatggaccttagctgggaatgtgatatcacttatccttcaatgattttttaaaagaattatacctgcatttaaagccttggcaaaatatggtaacattctagctactgaaaacccataagatattgtcccacataagatggataactttccactgaagatggataagttttagggtatctgaaccttttaaaccttgtgggtatcatttgtataatattctacttaatagtaaactctgccattcacagtgtcccctttctcatttttctagctacagttttcggcaagccatttggtgtgcttgcaatgctatcatgagctatggcttggcgttacaaggtctggagagtgaaagtgttttctgagtttctattttcaatagttattaggaaaacaattgaactttggctatttcctggtaggtttaactttcatttaagtgaggcatctgaatatttttgttgaaaatataatctttcaccatgaaactatctgagtttgagatttcagttataaaacacgctcttttcagtcattgaaaaaataacctcctgcaattttcctctgaaaaataaaaatgtgctttgatagagttttcgataattattatcatacatctgtgcatgtacccacaccattgtgttcatctcccatccatgtcattagtgaagatatggattaattccacattggatttcattgtatagaatctgggtatttatatctaaaaaaaagtgctgtcatttgattacatttaggcaaattttctcagtttataatctagaatgtgtgtttcggtcttcttctttaactggatgttctcaaagtatacttaaatggcatggccaaaccattgaagaaatacaacagtgatgactagtttctctgtgtctttccctgttcagcagttatagaggcatgattctatgattatttttgtgtaatctttgaatatgcaaaacaaattataacaaaaagctgtggactcttatgggattctaggtcgtgtatatttaattttcagcagcaaacttctccctatttgtaacttgttgatcttcttcagaaatattttcttttccatttaaaaattttaaactgagactacaatcaaacctttttcttttcttcatgtatagcaatgcttaagttatttgtatttcttataattaattttatctgcaaataacagaaatcctgaaataatagtggcttaaacaaagtagaagttaattttttatcctcatgttaaaacaaaaagtgcagacataaggagtctggagctggcagagtggctcagctgtcatcagggacctgggtttctgtatccttagcacactcaaggttgcctcatggttcaagactgctgctagattaccagccatcgcattaagaaggaagctagaaaagcgaagtgggaaaccaagagagttgtcctcttctttacaaagagtctttctgtggatcccatacatcacttctgcttaggtcttgttggtcagagctaattcacatgaccataccttgctgacgggaaggcttgggatgctagaactgtagttgggtgtaataccatcccaaatcccaaatatatttggtggctttttttgtttgtttgtttgtttgtttgttgttttttcgctaagaagaggaaatagactttgggataggaaatagcagtctttgctacctcactgttttcagattatgatattgtaagatatgctcaaaatactccaagtacaaatacttacattgcttgttgacagagtaaaataaattatataagtaaagctagttaggaacttgccatattggcagttcattttgaggatatttctaaaaatcatggactgcaggaggagaaataccaaagccaaacacataaaaatttcccacaactatatgaaaattccaaaatttatctatatggtaatcatatgtctggtgactttatttattcagaatatctctaagaaagagagagggttgtatatttgaccaattgtttttgtcaattcagagctgttgaacaattataaaattccaaagttctcagaaaatacttggctagtcatggtattgcatactgtagcttctttaaacactctgcagaattcttgggagttggtcatcagtagcagacggtaagaaaggttatgaagtctcctggttgtctgttgctaaaaaatcatcccaaaatatagtggcctgaaacagcaacaattattgatttgctcataattctacagtttggacaagattcagtggggatggcttatctctgccccatgtgccatcagatgggatagctcacctggaggggctgaaggatccacttccatggtggtttaatatacacagctatgaagtcagtgctggctgtctactgggaggtctcaattctcctcacgtgacctctccacatgactaggctgagcttttcacagaatggcagctgatttcaaagagggatcatcttggagaataagcattccaagagtacaagtcccagtgtgcaagtacttatccagttttttgttaatgtctcattagccaaatctagtcccatggcaattgggaggggctacccatggatatataaataccaggaggtgtggttctttggaggccatgaaagaaactttctgccacatttaagttctcaggcagaaaaaatagtgtttattgaggtactaccatgtgccggtcactgtccttaaacacagagctgccctgcataaaaggtcttattcgtcccattttccatttaagataaatgaggttcaaaatgttttaaatgacctgcaggaggttacaaaggtcctgtggtgaggctccatgtttcaatctacctctgaaaaactcctaagtctttgcactttgcagggcctccagctgcctttttaaccacatggtccattgtcactgctgcaggcacgtctgccctgtgtgctttcactctaagcacaataaaagacttaccacccgataagtctgttttttgaattgagaacaagagaaagagattcctgaacattctaattaaccaagtaccgctcctgtgccacagagatgcctagcagtgagagccgtaaaaggaaagtgcttggcagtgaagcaagacaagaaacctggtcctttgtgctctgccccattgcaagctttctcctagcaaacctgaccagtgacaacagtgtccaaagtcttttctagaaaggtctccatattggtacctttttcctgaagtaagggcttataacaagggcattaaaatatgctaatttctaatgctttctattaggcgtatccacatatcaaagcttttactggaacacctttgtcaaaaaaaaatataggtcatgcacatggccatgaaattccattctttatattttaagcagcatcaagattgttcttttccttcgctgtttggcagattagaattcctctttaaagtgggagaagttagttacttatcaaaccatttgattaattagctagacctgtcaggccaaacaggactagccaagtcttttaaatctcttaatatgagccaattttcacaataacttgttttattcatggccttcacattttaaattcttgctcattagtgacctggtatttgggcttgtctgaaaggagagcatccgttgtgttaaacagggctcattatggattataggttttcgaatggggatgcctatgcacaaaagatcgccctcccattttcctctgaatagttaattggaccttcaccttgtttttacaagcaaaggctaagcttcaataaggagataggcttttataatgccacagtttgggttgtactgaagagctggtgacctatcattatcaatacagatgtggaactaaagtacagcatgtgtttggttttgctagagacaataaaagtaatggctgtttttaaaaccagtaaaacactgaacttgatagaaggagaaattcattgaatatatcactctgcaatagttcaattccttgagtaataaaatacaaccaccaaacactcagaaataaacactagttaaaaaaaaaaaatgaaacacaagcctgaacccacaatacccatgcattgactcccaagaaaacagatttttacattccctaataaatacatgtattactatatccccaaggttttagcatcctcattgtatatcaggctaatgtctctaatacaaattctttttgaatttttcttagttaaaataatcttctgttttggtgtgtattttcaatttgttttaagattctgtttctgttgcttgcagtaattctttttattttcttttcctacagaatttactgtttatttccaaattactccagaccctaatagtctattttgcttttggcagaattcgtgtatctattgagttgcattctgttttgttgaatttcactcaatgcgtgtctctccaaaggcttcgttcagggacaaaacattcaactgcttctttagggcctttgggttgtgtttgtaacatgtatccacaatcagctgtcataataagccgagcatcctgattaattcactgtaccctccagtcgaagtattcacggatgtaactagttgaaatgcggatacacaagttcctactggtcttaaaagaaatgatttttctggtagttttataattttagcaattcagatttcgtacatttgaggttagaaaattcagcagacagcctaaatgcggcatcatgctaatggagtcctggaagctgctggtgttaaaatgagtaaattaaggagtcaacactgcttatttaggcacattaggataaaatagtatgagagctcggacttaacaaaaatcaattcagcacgcagagtgcacatccatcagggctttgttatgatgtcagggcgagcagcaaccctgttttattttatgaagaatgctacattagcatcatcgcgtccttggatggctgtgacatttgctgttatggaactactttgcggcagccacagggcccccagggactactccaactacattaaaaaattaggttggcatcaaatgacttattgaactctgtattgatatccttgggatttggttgtcaatctacacagtagttagtctcctttcacagcgaccgcattaagtaggaagttgtaacagttattgacgatttgagcaaattattttcctctatccagcccctacatacaacaacaatagtaataaacacagcttgagtgaaaagtatattccacatatggcatggatgctttgtttacatggtacgtggttttatttcacaataactcctaggtagatattatgtcctttctgagatttaagcattactttagtcacttaatcaaaaatcataaactgaagctcatgccattgaccccagttatataaaagaagtttgaaattttcttttgatctaggttttgcaccctgatagacttcacagataatgtaactaattagtaactgtgttttatttttgtgtacccatattctccttgccagaaaaaaaaaaaaagttgttggaacatactctttgctgtgtttcctcttggaaactattagccttcattattcagagtattggaggttagatatttaattttacaagcctaattattgactaacattttaataaacatttgacatttattaataagaattcaaaatatataaccatttaattttttacatactatctaatatctaatagtctcatatgaagtagaaaaaattacattcatgaaacactacactctattcatattatgatcacaccatcttttgttttccttcttttaaaatttttattttttgattatgaaattaatgtgcattcattggtaaagttcgggaaggcataataaagaaaataaagatgatatataccaattaaaggtaagccctgctaatagttgatattctttcagaattttttatattcattttcttctgtatatgtatacaattttcctatgtttgctttatatatattgttttgcaactagttcatgcattctaagtatatagcagaatttgtttcattaattacttgctattggaagttggttctgagctattttgaggatgaaaaacgtttctttgaccattcctgtatatacaacttctatgaaagaggcaaaaggttatgcatgctaaatattcagatgtgttaccaaaataccatccagaataacacctatgtaagaagttccctgattctcacttcacttttagggttaactgggacagtatggacattcttttcttaattcagtcattcaaagccatttgagtgcttactatgcattaggcactctgcaagacccaagagacagcagtggtaggagacagataatcctgctgcttacctggaatgtaccatgcaatgggtggagactaatctgaaataaataattgtacaaatgcctttctaatggaacttgtgctgtgaaggaatgttacgtcattgaacctgatctaggatggagagtcaggaaaagcttccctgaagaggtgacatttgacacttgaaaggggcaggtgtaatgagtttaatatatactgtgttacatcatgctaataactattaaccattgcatttttactgaggaatgctatgtatgttttggcacatcttaagtcagataattttattctgttttattgttggaccaaaaaaatggacaagttctcttttccacttctcttcccctttttgcccacaactacaattaacatgtgatggtccagaactattttttccttcttttttttttttttctatttaatgttacaaaggtaaacgtgtgccatggtagtttgctgtgcctatcaagctatcacctaggtgttaagcccagcgtgcattagctgcttttcctgatgctctccctcccaccgctccctgctcccccgccccacagtgtgttgcagaactatttttttttttttttttttgagacagagtctcactctgtcgcccaggctggagtacagtggcacaacctcccctcactgcaatcttcgcctcccgggttcatgccattctcctgcctcagcctcccaagtagctgggactacaggtgcctgccaccacgcccggctaatttttttgtatttttagcagagacggggtttcaccattttagccaggatggtctcaatctcctgacctcgtgatccacccgcctcggcctcccaaagtgctgggagaactattttttaaaggaaaatatggtctccaattcagaagagttgcacatctccaggatagggtttcatcttccaggcagtgtattcaggcagctcaacactactcattttttcacctgagccagctgaagttctagcggcagttgtctaatgatgatttttaagagtcataagcaaaaatgaggggacattggagcagtaccatatttagaatgcgaatattagtgcctccatagtctgaccttttctctctggacatattttatccatcactgtgtccacacatgccaaaatgactagtaaggaaatgaaaatatgtggcctttgaatgcaatttgtgaccaacattattttttgattaacagaatatatttttgtttcattgaatcaattattttatttagtatcagcattaattgtctacagacaaaatatctttggttctttgttaaacatttcaaaatgtgctttttattgtataaaactctacaactattatttccctagaagttcaatgcatacattgataatttattatgataaattgatgcagaatattgcatgatgtaatatgagtttcatgttgaattaagccatcacccctaaatatgaatctcaaagagctgtggctatttggtttctttatccaaagaaaaaatgattcataaccattgttgatgcaaatattactacttaagatgcaatgggtttctagtttcctctttgctgtgtaaaatgtatgcttggttgaccagaattcagtgaaacctctcattagggcactacggttcattaaggtttaaagaggcatcactgaaatttgaattggccatgctgtgattgccaagtctctctgagtggtaattgggctgtgttatgttgtgtgctttactgctgcaatggtttttagagttgttaaaaaataataataatagtgattaagctctgtgctatgtaaaactggcaagtttcttagtgatggcatctttttgtttataaattgagatttaaaaaatcatattcttacaaaaaacattcaaacaccaaatttgaatatcatactgagtttgttttttacttattggaaagagtatgttaacataattttgtttctatttcattttctcaaactggaagaaatatctggatgtgcacatagcactagaaaaatcaataagtaatctagatattgatttactgaatacccaacatgcagattgagagaaaccatattcaaaatgtgacaattcagttaaaagtgaactgaaacaagggtgcggttactaataggcagggaattactaggcagatgcatatcagagccagatccccaagggaagggcttatttcacctacgtgatagcacagtttgtactcaggcacttgagaaacaataatttaccataattgaaccagccacaaatatttattttgttaaatcagacccacaataccagcctgtctgtgctttgctggctagaaaatgtcctcatgagtcttaaatttatccttaaaatatatttaaaaaaataatcttaactggctttacctgtacctagttcaaatcgttttctctttatgcacggtgaaatctcaatgttggttactgtttctgcacatttccctcgggatggtggtttgtgagcatacctacctgtgctgctgtgttgcgagcctcactttgctcacctgggtttccccaagtgttgtgtttcaccactgggaggaactggccactgctgtcacctcaccacctaccataaggcctaatatatgacatatgtctaatatatatttgttgaataagttaattactctggattcctacctgtggcgcagtggctgacacacatatatctgcactgccttttgtgagtgactgaatgaacgtatgcatttgccatttgggaatattttcagttttatcgacgtgactgtttagaggcataatcacagacttataggaaaaaaacgtttaggaaataattctttgcagatatccttttggaatatccatgtaagatttgccttttgacagttactccccaatcctcctgcctaccttatccctcccattaaaaaaagagcaacaacagccgggtgctgtggctcagacctgtaatcccagcactttgggaggccgaggagggtggatcacctgaggtcgggagtttgagaccagcctggccaacatggcgaaaccccatctttactaaaaaatacaaacaatagccaggtgtggtggcgggcgcttgtaatcccggctactcaggaggctgaggcaggagaatcgcttgaaccgggaaggcggaggttgcagtgagctgagatcgcgccactgcactccagcctgggtgacaagagtgaaactccgtctcaaaaaaaaaaaaaaaaaaaaaaaaaaagcaacaacacaagatatctggcacacgttgtcctgccgagttgttgtgagtttgtcatcgttttcgtttgttgttgctgttgtgtaagcttcacgtttggtgattgttatgttcttggggatgcattctgactatattgggtccccttgagaccagtgttgcaaccaaaagaagcagagaagatgtagtccctaccctcccgcacctcgacttcatgcctttgcgagttttttttttttttttttttttttttgagagggagtctcgctctgtggcccaggctggagtgcagtggcacgatctcggctcactgcaagctctgcctcccgggttcacgccattctcctgcctcagcctcccgagtagctgggactgcaggtgcccgccaccatggccggctaattttttgtatttttttagttgaaacggggtttcactgtattagcctcgagttctttaactacttgatcttcactgaattgatcaggctgagaaagaaacagaacagtgtcagaagccaaccagtcaggtgaaaatattgtgttttgcaagtaaggggggttgaagaatgagagggatgggaaggagggaggtacagaggaggggagaagagcaggtgcgctaaggtatggaatggcagtttgaggaaggctgggtccacatcttctgttctgatgcaaccccctcactgctgcttcctagagggaccttcagaaagagccacatttgttttcaaggctttctggagttagacttctacctctttggggtgccccactggtctcaagggaatccaacacagtcaggatgcatccccaagagattgtaaatacatacaatttaattgttataattatctttttcctgtttgcatctcagttaaacattgtaaaaaatgttgagatgctacttctcttaatttcagttccctcacagagcagagcctgagtcaagatcttgagtgcaagcagtttacttgacttgtttatttgacttagcctgggaagtagaagtgaggtagagagtgagctaagaacaggggaaaacccagtgaaggatgtgctgtttagggggttaccactgtgggcaactgagttttggtcctgctgggaaccctctgaagaaccatgtagtaaatgtaacctcaaacctgcctatctaagtagcactgttcaatagaactttctgtaatgatggaaacattgtgtgtccacactgtcttctgccatagccacatgtagctgtttagcatctgaaatgtgactagtgtgactgaggaattacatttttagcattagttaattttagttaacgtaagtgtaaatagccatatatagctagtcactgctggattgcactgcacaggtccaaaggattggatgttcaggcgtttatcactaactctcattccatacgtggggcttatggggctgtgggtgttaactccctcatacttccaacctgccctgcaaggggctaagatagctgccatgacttaggagaaatccctgaggaagaaaaaattgagagaatcaaagtccttaagaggagacactgccttgatacaagaaaactgtccctgacagctgcagaagaaatcacaggctgagaggacacacaggaggcacaaagtacccgtgtgatgccaccttatgaggcattgaaaaagtgacagtttggtatattcatatctgtttttacgattctgaagtatcaaagttcacatcataagaaacgtaattctggtaataatcctgaagttttcagttaatttaatgcttggaaacttttaatgttttctaaatagctttttttcctctcttttaaaacttcaattatttcgattttactctaatgtaggtactaggacaaaacggtcacctcattagtatgtagtattttctgtgttttcaattattacattttgaaatgctagtggaaaatgctgtctgccttacttttttattttcatagaagtgtatttgaattggtttcaaccaccataaagactatttcaacttatttgttactaatgatgccatagcttagtaaattgcataagctgaataaaaatagtataacaaaaaatgtggcaactctagtgattcaaaatgtgaaaaatgatgaggctctattttcttaaagttagatttaaactattctatgaatatttacattttaaaaaattaaattttctgagaaaatcttgcttatccctaaagatacccatcaagctgtaaaaatgtagagtttatatagataaatgaaactacataatatattagagtgttgctatgtagatatgaaaacaaaatttactcttgctttttgcatttctatgaaataactgtttaaaggttaggaataaaggccaaaatttgcatttaaatggatatattttaagaagaaatgccaatttgtgacctttacccttgccgctagtatggttttttttttttaggattaacaatcaaacttcagaggaaacactagaaatataagcaaattgatagaaaatgtttagtttaaacagcttcccagaaaactgtttttatagcctgtagggagggctaattgggccttgtcatgaatcagtttaatcatgtaaaatatatttgatgactgcaatgatagtgaaagattgatccgtagtggtataaatcaggggtcccaatcactgcagactcagtggaaatgaatagttaaaattcgaagggacccattaagtgtatgatggcaatcacagatttaaggcttcattctatatatttatgtatgcattttaaaatcttaagaagatacttcaaaatatattagagaatttttaaatttgtaaaatctacaatgggtactacaatatatctacctgtgaaccaccacagttgctggttgaaattactttattctattatcttccaagttgtattagccattgttagatttcagtgttatcagggtaatagaaattaggtagtgattcaaagtgtgttttaaattattcctctcttttcattgactagttgcatgtctatgagaatatgtgtgtatatatatttatatgtgtgtatatatgtatatgtatagtctatacagattgactatgtataatatgtgtgtatatttatatatagactatacatatatagactctctatatatacatacatatgtatatatgtttgagtgagtgaatgattgagaaacagatagattcatcaaagctgactctcccctttatgtggtatagtagaactgaatggaacatgtttttagtttagtttttgctgatgtgtgcatgtaaagtcctctataacaacctttttttccaaaactgtgccatttccggcactgctttttcctccattgttactttttgtttattacttgcaccttggacacatgggggaaaagtcaacctccctggacaggttcaggaatcagaggatgaaggaaagaggatacatgaagacatatatgaagtaggagttctatttagaaatgaaagaacatgtgaaatatcagttaacatcggttcatatggagtccaggattctatttaatatatcagatagtcagtaaggtctaagagaggcaactgaagtaccctatttagaggaaagttggcatcatggaagtttgttagccattgcctgggctcagccattaggaaattgatattaagttgggacattcagtccttggtctactagagaaaaagacttagaaatctaggctcttaaagtctgagtgaagctaagggcaagtacagaggggatgacccaggagcacagtgcctatgggactgactctacctaattgtagttgcttgaggtcaatgtatcattgaatccacttgctcagatactggaccagagcaatttctactaccattgctctggaacagggcattgcaccattctcttagaaactggaccttaagaaactgtggccatttcaattccattttgatatttattacagatttcttagtagatgccagacagtgtgttaggtcccatcactcatattgccttagtatccattagggctaagtaccattttcttagctacactcttccgcatgtagcttatttaggaaaagtcgggcaagtgggttacagacatagtagaaaacattatgtcaaataacaacctgcccagcaatgaaagattttaccacgtcctttttgattcctatttttgctaaacaggtttaaatccttaaatggttacagaattcccccaaagagtagattatttgtaggtattagacaaaaacaatcaaacaaacaaaaaaaaccacaacaccataaaactaataaacacacacaaaaagtgaggggtccgtactcaaaaaaaattttggaaaagagtgggttaagcaagttattttacttctactgcagaggaggctttcagtttgctgttacgctgtaatacccaagagagactaatgtatgcagagtttcccaaaatcatttgatctgggaatagtttgtattgaagcatctttagtgactggtgtcctgtagcacaaattcgttaaaattccaatgctccagttttatccatcactaggaggagctaacctcagagaaactcagggaaggatgctgggaatggacctgctggttgtacttcaaaagaagcaaaggcaaaggggtccacacagaagccccaaagagaatcaaggttaatgaagggctctgcatatgatgactgtctttaaagtaggaatcctccaatctgaaatggcacagacactgaagagatagaattaaaatgtctaaaattatgaatgttatccataggttgcctatactagtcaatcaaattctggaagatggaaatgactagataaatccttccccttgctcccatcttgaggattaatttatgggtaagaggtccatagaggcttgttaataggaaatcagacttttacagctatatgctaacttttggcaatgatagacagttaaacagaatacttacctgaatgaatcagtttggcagaaacatgcacaggatttgaaaattttatgattccaaaagcatatctgaacatatgccaattgataacaaatattagatgatccaagaactatttggtgaaataatgaaggtagtttgtatagaaagcacctgtgcttatagagttcataaaagtttttcaaaatgataagaggaaataaaactcttgtaattaactagaaagatataatgtattgatctgtaaattaaagaattttaaataatgagtgttttctctcttcactcttgagcctgtttctttcctcaagaaaattttgattcctaaagactaaagtggaagtgtttattatgtatgcataataaatatctagaaaataataaatatctaaaaaaagacaaatcaacatctgacatgaactttgtctttccaaagaccatagaatgggctatgagtgaatatctttacaaagacaaacttatcattagaacatttttggttgtctaacaggcaggaaattgttaaaaaaaaatcttgttgcagtaatggagaaaaattagatgttcataggagctcccagtgaggataatcacatctgaatgcatccttgaaaataaacacaactcaacattttagtgttctattatttaaccaattggagtatgaatggatatgtaacaaagcttcaataatgtgtttcctcccagtaattgcgtttctttgtaaatgtctgtcctttgagctaactgtgtcttgaaatctcctgacttcataattctcaaaatcaggtgtctgagatggtactacaacaggctacttgagataagagtgaccatatttaatgatattgaccagtcaactaaacaaaataattattttgatcaatctttaccaactaactagcaaaatttaccttactatgacaaattctaatgttttacataggaaacaaaatactaatggctttacctatatcatgcccaaccaggaaatttaatttgattagtgttttgcatatactaaaatatttctatctggatacatgcaaggctccacagggtggggttagatttttttttttcaatgatacattccacattccccctgagggaaatgtcaactattatcaggcacagccaaaaaacaaaacaaaacaaaacaaaacaaaacaaacacatggaaacaaatgaaaagaacaaactgaaaaagtgttaagtccatactattgggcaaaaatagtagttaacatatgtaaaacaaggagaattgttcaaagcttttttttcttcttgatatgaatttgttgtaaggcaaatatcttgtttgagtcatttgtttattgtgtgtaagtgtatgtgggtgtgtaatcattttgcccatctcttttgtcaggaaccattaaattcagtgcccagaaagatgttgcaaatcagctactataaaattagaatatgctagaaacttgtaattaatagtataaaattcttttacaagaccagacgatggttctacattttatgttatattaaaaaatgagaaaacgtcatttgtgaaatttaataaggcagaacattattatgttcatattgaaagtcagactaatctgagtggattaagggtgccttgtggaatatcttgtgttagttgactaattcttgtcctcattattaatgttctgcagcaactgtaatacctacaagtaaacatcaattgaaaataacttcataaacatttcttaatcaccacagatagaatattgtttgctgtgttaatgcagattaaatagcataaatttacttttatctctttttaaaaaaataaattttgaaaagcagattagtgaatggcagagctgtcacccttgataaagctgtttcacatctttggagagcttaaacatgatacactgaagtgtgttcactgtcccttatgagcattaagtggtttgtaagataaaagagagaaaccagaagtgagaaggtttctattacaaacttagtcatatcatataaagggatggcgtagattaaatccctactcccaccctttgccacctccccttcactccccagaacttcaactgtcctttatgacacacaactgagcaggagacatagaatcacatttttcacagggatttgaaatgtctttgtggtcatggtctggcagtaatagaagccatatgctgtgggtcaggaagaaagctatctcgaaacagaagaacccatctcctggcctaatgaccttgggaacgtttagtcatttcaaggcatttatcgttgaagcagcgtaggggtcgtttgggctatgttttcctccatgtgactccaagttgtgagggggagaagtgcatattatccataaagaagacagcatcagtgataagtaagtggctaatgtcagtagcaataaaattctcttccagggcacctgttagctgatttgttgtagattgatttgcatttccctttgtgattttgaactccttttagcttcttaatactttaaaacacaagtctgatggaatgagagatcgcatgaaagaatttgatttaagctgagtactttgtggacattggaaaagcagcttttgtcttaaattacattgcctttggaataccagcatgtaagacaaagaaacatgatctttgtaatggctgttggcccatctccagttgacacacacatgcaagttatatgggctgggtcacttgaggtttcccatttcccataaaataatgtttatcatggcatggtggggcttaaaattggttcctaagtaatttttgctccagtctcttatagttgtctctgagtatgtccccagaactgacagtgatttggaggcattgaccatttaacatgatactggtggacattgatcagatggccagtatttgggtaaaacttatatttggaagaggagaactgatttttggatattaggaaaaagagagccccctccccaacttcaccaacactgctgaattccgattataggtataagcaggaattttctaaaattttagattaggttttaccagaaattctcaatattctactgctgaatctttaaactaccagacaccttttgctctccattttctcaaattggaaaggggtgatgaaaatggtaaaatgtctcttccctcttcctttgttctcagggatgtttgttactcatccttctacttgcagctagtatataaaacatcttttagagtctccatgtcttttttttttttttcttttttgagatggagtttcactcttgttgcccaggctggagtgcagtggtactatctccgctcactgcaacctctgcctcccaggttcaagcaattctcctgcctcagcctcccaagtagctgggactacaggtgcctgccaccatggctggctaatttttgtatttttactagagacggggtttcgccatgttggccaggctggtcttgagctcctggcctctagtgatctgtccatctcagactcccaaagtgctgggattacaagcgtgagccatcacgcctggccagaatctccatcttaaactggcttcctgaaagagtaaattgatcaagcttaaaataattttctgctgttctttttttccagtagggacaaggtcttgccatgttgcccaggctggtcttgggctcttggactcaagcaatcctcccacctcagcctctcaaagtgctaggattacaggcctgagcccccatgcccagtctcctggtgttcttggagggttttcctctgtaggtacttgttcatttgtgtccagagagacttgggagactataatcaatactcttatcagccagaacaacatacattaaaactaaaagaaaaagaggaaggttgagttaaactggccctaaaaatattgatgttctctcattggaaaggttgacaggttctttcaaggaaaggtcatttcaggaacataagaagtctttttcactttactctttgctcttatctgaaagctcatcacagtgttctataatattttatcatgattctgataggtttcaggatgaaaaatggaatttggcttaaagagtgcagggctagtatgaggacactgcactctgaaataagtcagagtgatttgtcttcatcagatgttccataataatacttaacttttactgtatgacgtgaaacgagtgttattatttcaaaaaatgtatttgtaaatttcaggtcaaaactaagaataactctaagagtgtaaaaaataacatattttaatgttaaatttttttattgcttacactctaaatattttcctttgaccaatatgagaaatattcccattgatatctctgtgcatttaaacaattgtgaaaatagagaactcagttatagttaaatgactgatgttctataagataactttatcacatagataaaataatgaagaaaagaaattaaataggcattcctctgagagtttctctgacaatcaaatcagaggttttgattgaaaaattccctcattaatgtagattgagtgaatgaactaattactttgtaatttgttctaatagaaactttccactgaggtgaggggcaaggggaaaccccaccgtcttcactgtcatggaaaagataaagaagtaatggatctttgaaatatttcccctaactttcaaaaccttagcttacagtgttggagactacctgagattacctttcaagtagatgttttcaggaaaaaaaaaagaatatagaaaggcagcccttgccacatacaatgtatttgaatgacactacaatgcagcttttgtaggtgatcagatagaagtgtcttgctgttctattgtatttcagcttgaatatccttcatcaaggcagttactgcaaaacaatgttgtaaatgaaagttaaaatgacattattataagtaaacttgagttttcttttattacctgtcatttataaggtggtaatgcaccacgaaaggaattgcatattttgggtaataaagaaatattctatgaccttggtattacttatactaagattggttttaagacttttattttgggtactatagagtagagaccatgtcattccccctttcctaccccatttagacattaagacattcttagtgatttttttataagtacctgtcttcatccattttctgctgctgtataacagaataccaccaactaggtaacttacaaagaaaagaggttttttgtttgtttgtttgtttgtttattcacgagtctagaggctgggaagtccaaaattaaagggctgcatctggtgagtgccttcttgctgcatcatggcatgattgaaggcatcgcatggcgagaccgaccgttctctagagagaggaaatgtggcctaactcccttcttttataactgtcccacttctgcaataataaacccactctcatgataacagccttcatccattcaggagggtgctgccccctgacctaatcacctcttagaggtcccacctctcaagatcacaatggcaattaaatttcaacatgaattttggaggggacattcaaaccatagcagtaccttttttctgaagtctccccagagcagtaatctttagtcctgaatatttcactgaaacacttacatgtagaggtattttcttaaaattgagacctgtctttattaaaaattatttatagtgatactcttttctgttctgtttacagtatatctgaggaaatataaagtgtatgctattaggctttgtaatgtcttattattaaggcagatataatagctttaaagagaacactgatggatagctttttagactcaaagcagatatttgtgtgcgattaaagtagaaaatgataccctacaattgttgagacatttttgatgttctttggctttccacactgatctttttctatctctacagttagtttggttttggattaatgtttttcattcagatataggaaatcagtagcacttgaaatgccatccatagtacactgaagtcttcagtgaaacaacagagtccaatattcaatcagaaaagaaaatgaactctaggagtcatttccaggagacatgtctgaagtcaaacttgggctttatttcctgtcttcagagggtgcactttcatagttgttttctataaggttcaaatcccagagtgtatgtgccactctctctccatttataccataaacaaaaattcaggtctttatcatttcacaccctggctgtcaatgtggctgtctctccagcttctggtctgctagctccccttctaccatccccaactcttattccctggcttaatttttataaaacaactatctgatcatctcatttcatgttcattaactttttttttttttttttttgctgcctctaggatataatgtctaggctctttgtgttatgactggggctaggaaagaaagccattatctaactgaatggcctctgaaggaaatattagagcttttctataaatttatttttctcatccttctaaatctgcatgtttgtatatattttattatatatatatactttacccatacagtagtatatgcatataattgatgaataaaaatacatatcttgggatatgctcaaaatacattttactaagagaatgcatacatgtggcagttatagattattaatgtcactttatttttctcttcttacttttccactaggtgagcaaggcaggtaaattaaatctgtcctgttgatggactgaaaactaacctcaatacattctctcaaatatgctacaggagttttgatttgttcatgaatttatttttattttcctacaaaggcaactggtaaacactgcctcgcttttgtttacctcctttctttttgacttttctttctgagaacttttgttttcttgggcatatttcaaagagctactaactttatttcttacatttggcccaaactggcttctatttgcccactcttgttaactcctttgccatgagactgtacttttaatgtatactctttgtttgtacaagttcttttcttttcagtagttgtttctctttcagccttaacttatggccctatgttctgatgcttgcaacctgccaagtactttccaagccctacacccctgtggtcatctggtacaattggtactgccattagcaccacttccaccatcaccaagctgtcctgcctccattagttcactttgcctcttatgcttcttctctcacatagatatctcagtgcatatctgagactatcctggccttccacctcatggttcactcacactgattatgagtttttcttgttctaggagctaaaaatatctctcctgccatggcctgagggtctcaacattccatattctcttcatagtaagataattttttttcccccaaaatcccagtagtctgggtggcaaagtactggttcaaaaaagttgatagtcccagcactttgggaggctgaggagggtggatcacttgaggttaggagttcgagaccagcctggctaacatgatgaaacctcatctctactaaaagtacaaaaaaaattagccaggcttggtggcagatgcctataatcccagctactcgggaggctgagacgggagaatcgcttgaacccaggagatggatgttgcggtgagccaagatggcgccactgcactccagccttggtgacagagcaagactccatctcaaaaaaataaaaaataaaaataaaaacgctgatagaagggcatctcttcataacactaactgtcccctgactacctcaacctaaatactccttcttgttttctttttcctactttagtataaactcagatactttaagacaaaaggggtacttctttctctcaaaaagaaaggcataaacatagtgtcctaggcaaactggtccttatgcttactataaatcaatccaagacaactaactatcaaaaggaacagtagaatattctttctggaattttaacagaagaagaagagccttccctgtggattttctgagtgatatatggattcaagctctttacattctggccctgtctgccttcttaaacgtatctcccttcttctttttctaatattcctgtcacattgagctattctctatttcttagacacagtctacctctctgcctttgtccatggccttaaatgccttcccagccacaatctagctgttgaaatctcatccatccttgaatatctagctcatgtaatggtaatggccatagaacagcttctactaaccacccccagcaaaagcaacctctttctctctcatgtgatgccttatgacatttatttcataatcttgtcacatcctcactttatgatttctcgtatgtaatttaaaaaattacataatatctaacctgctagtttgtaagttctttgaggacaggttctatgtcaaattcatctttgtatattcctgacagcctagttacaatgatattaatatattggagtcacagttgtatttctagagaggattatatggctgaacaaaatgtttcacaatgatatgttcttctgatggaattttttaacctaagattactgagaatttcttggtcagcaaaaagacaggagtatatcattctgacactcttttgaggcacatgtttattcaatgtccaccctctcacaagcagatatttaataattaaaaaaagaaaatctgcagcttgattatatgcttagccaagaaattcttttgcagttctaaggaaaatctccagcaaacccaattactctcccagcaatgcacttcaaaggagagcagaatgcatttcttgtacagaattcctggatatgtttgatcattagttagggcaagtagtttgacttgaggctatttactcagcaggaataaaaagtacagcattgcttcaaccaagaggagtgccccataccttccccaagcagaatttaataatttgatctgtcagaggaggtacagaggttggctatagaaatgagtcacgaccagtcagatttggctgacttgtgggccattaaaaatgttccttcccccaaacggcattttttaggaataataataacagaaacagttggcaccatgtaattgaccaagaacctgagaatttcacagcagtacttatcactgaaacagtttttgtttttttgagtctaagccaaatccacacttgagtatttttttaatttatccaggtgttctatggctaatatttatttcatctagcaagtgccacaaagtatttttgatgtagtcaaaaaaagtatttctgatgtagtttaaaaaagtatttttggtgtagtcaagaatataacatgatattattagactcctaattacaaatatttggtagagactatcagtttaagaaaaaattgcattaaaatgtcaacttttttctttttttgagacggagtctcgcactgcacactgtcacctgggctggagtgcagtgacgatctcggctcactgcaacctccacctcctgcattcaagtgattctcatgcctcagcctcctgagtagctggagttacaggcgcacgccaccatgcctggctaattttttgtatttttagtaaagatggggtttcaccatgttggtcaggctggaagttttttcgaaaactaaatatatatttcattatataaggtagactttacactttttgggaggaaaatgcacatcaccttttaattttttttttgagacggagtctccctctctcacccaggctggagtacagtggcacgatctcagctcaatgcaagctctgcctcccgggttcacgccactctcctgcctcagcctcctgagtagctgggaccacaggcgcccgccaccacgcctggctaattttttatatttttagtagagacagggttttgccgtgttagccaggatggtcttgatctcctgaccttgtgatccgcctgtctcggcctcccaaagtgctgggattacaggcgtgagccaccgcatccggccttaatatgtaatttttaagcactttaggttttaattaaattttatttcagttataaaaatgttcattaccatttggcatattcctcagctaaaataattaacaataattaaaattacccatgcttgattttcttatttcaatttttataaaagttatgccttcagtttatagaaaataaagaaacttatgtacacatcgatgctttagacaatatctatttttcaccatgaatatcactgaaagaaacaagtatcttttcatctttagacaaaagaaaaaaaagtactagtgtatcttttattattggttactttaaaaaaagagtaaaactacttctgtaacattaatttttaaaagttaattctcatattctaatgggagtgtaatgagtttttctcacagtgaactctaatgagtttaggaacgtgctgccatatttatggtagagactatgcaaattggactgatgtttatttatgcatttatttcatttgggaatctagttttcgaccttaagtttgctggagaatttgttacaggaaagaaagtgtatgaagaagtcttcttgtcccaggtgtggaattaaggtaaaattaacaaggaattgaagttatctttgatcatgatttttgattccatttttattcactttgaggaagtgttgcctgttttttttttttttttttttgatgttcagcagagcagtacaatgcaacacacagaagcataatgttgaattttcataataatgtttgtgatgcaaatgaggcacacttcaaaaagtagaatgattagcatttcttggtaagatgacagtccccccttttaaaaaaaaattgttcattagttttatcaatagattacatatccagatttcaattttgagtgcatactttttgcttataattataatgtgaatttaaatagttttagattgtgcatttaaaacaattcttctgtcactgtattatactctgaattaatgagctgtttgccacctcagagccctttgctttgaaattcagtccagtttaaagtgaactccaaccatttcaggccagcagctcacagaaggttgcaggattaatgagctccaggggctctgtggcttccttagaagcatttatcactaaattctattcttagggaatatcatccttatgcaagaagatggggagctgaatgtggaaaaatgctattcaaacaaataatttgataattgccaatgaagagtgttctttcttctcactacagatgaaatacaagagatgcagctaagaccagagcttttagtttctctaactggagtgaaattaaaattgatggatattttgataagattactaatgtaggtgaaacaatgcttccctatagcttgttctacaacactgtactcattcacttactggacttcctagggcttacttaaagaacttgtacacatccactgtcaaatatacttctgcatacatatactcttggatatcatagcctatttataaaactgtatctgtctccctagttatcctgtaggaatagctagtgttttctctccttttagatcttctcaaggcatcctctgagtttataaaacagagagtaatatgggtgagaaagttggcccttgctctttttttttctttgagtatgctgtttttatttaattctcacaatatctggagatagtaatttttaacataatgaaacagatttagagcaagtgcatgacaagtaaaaagcagggccggaatttgaatccacattcatttgactctaagcctgtactgtctgatatagcaagcacctgtagttattgaccacttgaaatgtggtgattgctgcttgttaaaatcataataatttcgatatattcatgcaaataaatatattactaaaattctacctagagaggcatttcctgggagctgacaatcccctttttaaaataatgattattaattttatgagtagattatataatcggattttcatcttgaaggcaaactgtttacctcttgggagagtttgtgtacctgaggttgtgccgtctaattagggcagcctgggccaaggatggtaaattcatggcaatcacatggatactccacatcctccggcagacatcacttatcggtcgtggcatttttctcacaggaacagcattctgtctcactgagacacagccttggaattcttctcagtactgttcattgatccaggcagcccccacctcttgactggagttggcaagtgagataaacatgttagctgactctcttctggtcagggctctttggcacagttaggtgctctgaccttttgaatagacctgcaaaatgcaagcctatcttcagctttcaattagatgttaggatatgaaaacatgggcatctttaaattgatgaaatattcagccacttcaggtctgtttcttcccagctaatcatgcttgtcatctacattttattccaccaactttattcaggttttacccctcacctcatgattgctttattgctagaatgtgaaaatatcttctatgcctaaattgatatccttgaattaaaggtgtgttgatgttgcgactctaacttcggtgtgctggggctgtcttgcagcagtagggagtgaagtctaggcctaccaagcattacgtgatgtccttcctcaagccctctctcagccaggcacagtggctcatgcctgtaatcctagcactttgggaggccgagacaggtgatcacttgaggtcaggagttcaaaaccagcctggccaacacggtgaaaccccgtctctactaaaaatacaaaaaattagccgagtgtggtggagggcgcctgtaatcccagccactcgggaggctaaggcaggagaatcgcttgaacctgggaggtggaggttgcagtgaactgagattgcgccagtgcactccaacctgggtggcagggcaagactttgtctcaaaataaatacatagataagtagtaactctcacatctaaagagcaagagcagactgtagcagataaatgtcccaataaaaataggctcctaacccttactctggcatttgtgtttcatcgtagcaaatttggatgcaagaaagctattgaaactgaatcttctcctacacctgaagagatctattacttcaatcactccaccgaaaaatctaccaaagattaagtatgtttctctattgtattcctgcaggttaggattgttacagatcacaatgacttaatgaaatctcaatacttgtggccaaaataacgtaggatggagagccatagtttaaaagtttgaaagctttgggggtcatctaggacactgaaattctgcttgcaacttgtttagctggaaaacaaaaagcatgaagataagactggaagatgaacatctcataccatcaatatatgggtgattagaagctctacaacaattctaaaacccagcctaataaagtatgaaacattctgaggaatgttcataaagatatgcaaatggactttgaaatggaaaaaatgcaaatcagttgaggtggcacaggcctaatttacccattctctctcagggaatatcagagcttcacacatttaacaggaaatgtacacatgctgacttccttcaggtgaaaaaaagattccacctgcaactagtattaaatatttgagatttgtttgccactgttgtatcacagatgcttcaactagagtgtttaattttcacacatataccatttaggagctgtttagtcctctccctaatgaaagagagatgggaaatccaggacaccccacacttactggtaggtttccaaatgttccgctcttagatgccactggtacctctaaataattcaaaatatcgaagagctgactccacacagcagaatgtgttttcttagttggaattaggtctataatcagacagagatgtcttattagtcagaatggaagacaacggactggtaaatattataatttgaaaatgttgatataaaagaagcctcaacataggaaaaggtgacatgaatgtcaatggcaattataatatataaaaaagataatagtgttttagagagtgatgaatagctgtgggaggaagagttgaggccagattttgcaacttctaattttttttttaaacctagcattgacagtacagtcctgaattgttgtgttgtgataggacataccttttgctattaaaaaataaggcctcatattattattaattttttttggccttctgcctaggaaaagaagtatgtctttggaaataaaaatacacaaagtaagttgtcattgagggaaagagttaaaaagaatcacttaccttttatgaattattttttaagactacacaggtgagttttttggttttggaaattcttgaacattttgatttcattcttcctggagagccaccgatactggaggctggacaccacataacaaattaaccgtcctctttcatttgtaacctccagggagataagatcagtttagttgctaatgaattttggtccccagcacagaacaattacaatggaatatgaggacggtttcaagagcatcaggaagattttaccaaattctatttaatctcctctcaccctgtttacaggtcagcttattaaagttgaaaattcctggtagatggtttccatggagagagaaaattatctctttagataaactattctagggttaatttgattcaaccaacatttatttagagtttcacatgtgaaacacaatactgtcttaggagctacagggatactaagatgaacgtggaaaaaaatgattgcccttaattaagttggcatgaagttcatgtacacaaagatgtacacggatctaggataaaatgtggcaagtactatcatgtaagtataaataaataaaaaattgtactcttcatacaaagtcttgtttgcccctcataacaaccctatttgaagagataattattcccatttcacagaaaacaaaacagtgtcataaagcagcacatctggtaagtaaagccaggacttgagcccacgctgtataccagccatcccacagagctttcttgatgctagggagaagccagtaataaagcatttcatagagaaggtggcatggtaatggaccttgaaagacaggtgtcatctcaaaaggtggccagaggggacatgtcagagagtcatgcatgaaagaggaaatttaagctttaaggacaggacagatgagacttccaaggggagagcagagattgggaagagcatctgaaagtgagccctctggaacactccatgagggatgggagcaggcgggaggaggaagcgcaggagccagctaaggagacagggaaagagcagtctggccgatgtgagatcatcttggacagcgaggtggccaagaaaccaaggtacaacagtgcagaaaatcaaagaggcccccacagtagtccgtttcagagagaaagatacacagagctaaaaggaccccaagagtcttcttgatctgggggtcactggtgactatagaaagaatagttttattagagtgatgataagccatagatcatgggaaaaattgcagtgggcaaaggatgaagtaaaaggggaagagggtgacatgaaagttgatcactgtttcaagaagtttagtagtggaggaaagagggaatagtggtattagttttgcacactcacaagcccaggtaggatcctcattttggagagcctctggtaacatctgataagcgagcaggccccttaggtggctctgtgacagagcttttgttctgaggatgccagcatgaggccacactttagtatcaagtcacaggacccctgcacctttgtgtgtcagcctgacctggggcataggactagagggcaatgggaaatcatacttgtccagttggaagcaaattttttgcagaaatttgctttcatggcttaacattcataatgccttaggttgggaaaccacccatgcccatttatgggccatggttaattctgttttattctgttcaacaaacttatccctaggtactctgtgtgaagccccactgtggctcggagtctacagcatgtttcaaagacgttgctgtcctcaagaaacataatctctttggggaagcaagaagcaaaagtagccctttactgtagtctgatgaatgttgccgtgtaggaatgggtgaagggcctggtcatagaaggacttacatatcacgcttggcactcagatcttactctgtagataatggggaaattctatagtgttttaataggaagcagcttcactgttttcatttattctcactgaggtgtgaacagtgtgtgtgtgtgtgtctgtgtgtgtgtgtgtgtgtgtgtgtgtataaatggggatagagaagcaagtttgtgacatataaagcaacagtctagataagaaaccttgaccttaattaggccagaggaagtgggtttggagagggcaggtgacacttgcttttgttagtgactgaattcactaacaaaaggggtgcggaagagttaggttgcataggtgcttcctgggttttttctggttgactggaaatgctttcatggcccgtcttcctgtctaaattaagatgttcatagatgttttaaaaatagggtggagtctggaggtagaagacaaagctgtataaagtcaaagtagggagaaaaaaaatgaagaaaggcaataaagagaaatagagacagccagtaattatttgctgtcacaacccattcttaggtcacctttcggtttcagttttccagcaatacttttctttttttctcctcttttcattattaaatgccttaagaaatgagtatgctgcatcgatagagttatgatggcttacatgagaagagcttctgagaagtgagttcctggaagcactgtggtggtggccaagtatttgcttataagattttatttgacatctataaggagaaatatacacaaacttttttgttttgttttgttttgttttgttttggtgctggaagtgggaaaagtaacaagaatttaatgagtaataaggaaatgtaagaggaaccattaaacataactatagttacatggaccctacttactccaagtgtattttagttagatttgggtgtattttgtgtctgttaaggcaggtgggcagtttgttcatttggctggaatcctggggcaattaggtcagcattaggggcttagtatttctgcaggccatttagttttaacctgctccatgaccccaggacactttctacctcatcattaccctgatttttgtccgtgagttcagggaggcaccaatcagagaatgtcgatagctttctagcacatccatcttcaccaggagaaagctgtggtcagataagtaggattcccctttacataaaaagaacagcctgttccatcgttagaaaaattagaaactgcggtgagaagtgcaataattagtgactactgaatgcttgttcttgaatttgctttataaaaaatgggatctgggagccttgttaattatatagctttgtaagaatagtttttctataactgtattagtatacttaatcaatgactcatagaatactggtaactaatagacctggacttaacgcctggaatgtcctactaagcatggtttggtgagctgtctactttgattctaggatagtttatgtttaattatgccacaacttgggcttatgctatgtcttgatgtaatgcaaataaaatagattatattttacactacaaagttcattaaaaaacaaaaacaaaatccttaagcttgtcactcaaaagtaaacatctgtatccaatgcaggaaagaatgcaggtttcgtggggactaaaacaacactaaggtgagctctctttaagaaaaagacaaatgggccgggcacgatggctcacgcctataatcctagcactttgggaggccgaggcgggtggatcacaaggccaggagatcgagaccatcctggctaacacggtgaaaccccatctctactaaaattacagaaaattagccgggtgtggtggtggacgcctgtagtcccagctactcgggaggctgaggcaggagaatggcgtgaacccggcagacggagcttgcagtgagccgagatcgcaccactgcactccagcctgggcgacagaatgagactccgtctcaaaaaaaaagacaaatgtacaatataaaattaagtataaagtggttatttaaattcagtctttcctgtaaggtgatggaattttcaaaaagtattaatagttgagaaaggtttttctccattttataactctcgattgataataacgtgtacatttttagaattgtggttaaacttgggaagacttctttaggcttctttcccgatgaactgcaagattttacagcatctcaaaatttctggtgcagggactaatcttaaatactttggaactggctgtcttcattaactagcttgttaccatagatttctcacatttgctaattaaaaaaatatgaccatatgaacacattgccaggaccccatccaagtccttaaaagggacctggcgggggaaggtccctgaagcttaagctccattgtttcatggtaaatttatctctgatctgacagcatcataattttccactgaatctgtccaaacagtattatactcaatagtccaacaaaacaacataacctttcatacttaatacaataagtcaattggggaagaattcagaattttagtgatcctaccaagttttttttttttttttttttttttttttttaataaggcacagctcaattcttatctcttggtttgactggcatacaatggcttattgtaagactattacgttaatatctttgtatcttttacaagctttaatttacccctgatagcatgaaacgagactaaattctcatataagaacatgaaaacatttttaaagatgttatctcttatggtatgtcttatagtccactgactagattagttgtaggcatctaaaataacaagtaatctcaacagatagtatatagttaaatagaaatatcgtatttctaagcaattaccttgtaaagagaacccttaacattttaaaatgttgttatttctaagcctaaaataaaatgcagcttgttatttaaaagatttcagaagagatataaagatcccattgcactttacatggctttgtgttaaatttatcaagatccattatattacatgaaacatacttagtttcattaaagatgcttgagcctctctcttttttatgcttcctgccccctctatgtacacaaattcagcaacctaatcatgttgcctttgatcaaattttatttgtatttttccccagtaatgctgtctggtggcagttaaatagaatttaattaaaataaatattcacatgctttaatagagattaatgatctgatttgacttagtaaaatttggcaaaaagtctagacgctgtaagatatacctatattacttgacttggataaaggtttaataaaacacagccagcattcaaaaaaagggagaaatggggaaatccagttataaaagctatctgagcatttagctagaactatgcatacacaaacacgccctattgaatttgtgtccacaataaaaattgggctgtttcttgtttttctattttattacaaccataaaatgaaagtgtgaataacaaggcaatccacttgttaagtggcaatttggattgacaagctattttcccaaatttaatttctggatctgtacttctcagcctttaatgtgaacatgaataacccaggggtggtgtgaaaatacagattcagattcagcaggttttggacaaagcccaagatactgtgttctaacaagatcccaggtagtgtccatgctgctggtgtgaggactgcaccttgagcagcaaggtcctagacagtgaagtgaagagactagatttgggatggttgccgccaccatcatcaccacaattgtatggataataatatgtaaatgaccccacctctcaaatatacagtcctttcacatatttccatcatctcattttggtcttcacaatatataatgtcacatgcgtatctcagcctgagtgccactgcttgtaaagccaattaattacataagaatattaaatttcagagtcttaacccatatagtccagcataaacaaagcatagctaggtttatctttccaaagggtattctccaaatcttgttattttctcactcaagattcatccagtggaatatctcctctgctccccaatcccataaaccgttatccctattctctctctgttctccaaggctgatcatctcactgtcctccacacagattagttttatttatgaatccaaattctgcacatgcagttgcctgaccaagaatgctcccacttatatctcctgctcttcatgaaatctggtaaactacttcctgcacacacaggcgttgaggggcctggccccttatcatctgacagacctgaacaaggtgaagacactctagagctgttggaattgttctcatgtatgctgggagatattttttagcttccttatgtgctgcattttaaaacaccctaacatttgtgcccattaactcccaagccctgtttcttttagataatgtatcaagcaaatttctatagttgaagttctgaagtgtgacaagggagccctgccttagcacacatgtccagatgttgacactacaagttataagcagccttcatttacaaaattcagacttaaaagccacgaagtgaataggtaattaatgcggaaagtggcaagatttgatttaaacagaaggagccattagacaattaaatactaatttaaaggaattctcacattaagttcaataaaattaaacattaataatgaacaattaatacctttgtggagttatttagtcaatagggaactgtgctttttttgtttgttttgttttgttttgttttgtttgagacaaagtctcactcttgtcgcccaggctggagtacagtggtgcgatctcggctctctgcaacctccgcctcccgggttcaagcgattctcctgcctcagcctcccgagtagctgggattacaggcgcctgccaccacgcatggctaatttttgtatttttagtagagactgggtttcaccatgttggccaggctggtctcatactcctgatctcaggtgatccgcctgcctccgccctccaaagtgctgggattacaggcgtgagccacagtgcctggccgaggaatgttttatataatagtcccacttgtaggatatttgttagaaagagagtcacatgatacatttttatcactcttatctgctacttagagatttggcacctatagcaaggtgataaatacgccccaagggtgcaactggaaaatgtggttaacccgatgcaggagtctgagtggaactctgaacaggatgagacaagccggcagtgacctgttgagcccttggaccccagaatttctcgggttattgtttctccgaacagccactcagaagagattctttgagttgatgcaaaaatctcaaaacttactgtgtgactttgtggtagaaaagaaaaaatgcaatttggatccagattacaaacttgattgtgaaaaacaaaaacaaaaacagatagtccttatgattttggaatgatacagttaagggtggtgtaggagatcaaataaattatcctttaacatccagactataagattttgacttctacctacccaaagcacttgggtcagtatacgttttagtgcactgatgcatccacttgcccgtgtgaatgcattaaggacaggatatcgtattcttctaagcaaaaagattgcagcatactctacgcacagcactgggtagaaatcccactattccacttcgtagcaatgcgactttaaacatgttttcaaacctgtgtgagccttagttcatctgtctgtaaaatggtgataatagtagtactcacctcaaaggttgttgtaaggattacatgagtaaagtgaaagttttgatttaggggaaaagaggcagaacatgaagtactaatttaaagaaatattcaggtaaagcctatgagattaagtagtcacgaatggttaatacttccatgcagtgccatctaatagggcttcactatgatgatgcaaaggcatgagaatgatataatggactctggggactcaaggggaaggttgggaggggggtgagcggtaaaagactacatattaggtgtagtatatcctgcttaggtgatggctgtggtgcactaaaatctcagaaattaccactaaagaacctatccgtgtaaccaaaaccacctgtaccccaaaaactattgaaattaaataaataaataaatagggttcactgccaagcaaatagaaagcattctataaatgttaattatagaaagtgttctatttaagtgttaattattataataatcatgattgctggtgtggaattaagaaaaaggcaagggctgcatctttagaaatgctttaattcatgtaaagtgcttaaaacagtgcctgtgtgcatgtgtgcttcataaatgctagtcgttgttattataagagttactatgatcatgctagtgctcatccttacctgacttctggagtacccatcatattcaatattccaaaagataaacacaatactatttgttggatatttatcttttaaggcaactattaaaccattggaatggtgattttctgagagattcttcttttttaaaccattgacaactttattctgctattgagattttttttcagagccaacatttctttcatttataattctactttggaaatgcaaatgttatccatttttccaatgcatagtttcaacttactagttagctctgtaaatatcatttatgagactgacccatgttagatctttgctatggtctgtggtttgcaataattgtcattctcagttcccttaagtactaaataggagaaaagacagtagaatgttaaatcaggacaggggtctttggaggtcactctgtccagcatcctgattttttagataaggagacatgacttgtccagtgtcacctagcagctcagaggcaaatccaggacaacattcttaaaggtcatacattgaccctctgttaaataagtgaacacataagtatatccattaatttcagattgttttaagaataaaaatcaaagttatataaggttcctgaataaatctcatagcaggagggagaccatgtgataaaaccttcaaaaaaatggaatatattgtctggttgcttcctgaattgtacaggttactatttcatttctgaatatggcctcaaataaattgaaaagtacatcccttaaatccttgtcaagtgcaaggtctgtgtcataaatgctttcaatattgagggggaacaggacaaaaatttaaggaaaagaatttatgcaaaagattgaatcaatgctttttttggataagcaaagcaatctgtgtgataattctactttcctcctcccctttgtgaagctgggtgggggtgggaggattagcaagaagggaggggcctaatttatggcgagagtgagaactcttttcaagcctgtgggcagaaaacaccgctgcacctccctcccggctggaacctgctctctgtgatctgggactcctccgggtctctgtttgcctaattgcaacttgtgcttatgccctccagttctcactggcccctttgatgcttttcagcaagtcctctgaaagcagcaggacaaaatgggaaggtaagcaatcctttcacataaaagagggcagcaaaacccaggtggaggtccctgctgagatgctcccttccaaggctgtgaccacacagcctaagcaaacactgtgactagtgccagcaaatgaaatttacagccctcttaacctgcaagccacagccagcatctcactccactctccaaaataaattcaacgtggctattttagaaaacatacttatcccaggttttccttttgggcatctaaggactgaattagatggtctccatctctaactacatccccattctggagactttaaaaaaaaaaaattgctttgtttatttatgtgttcatctcatgtttatcagttcagcagttcacagtttttattctgttatataacaaaggagcctaacaaaggatcacaataggaaaaataatttaccccacatggttacaatgaagagaatttaattaaaggaattgttacaaagtgtgggcagcattgagggaactgacacaagatgttgagccactcaaagactagcaactggtggaagccgttactacccacttaggcctacctaaatgggcaatgggaagataatgttaatggagcccagtgagctctagagcctcggaggaagggcatcctgcagagatgttgttctcagtcttgtctactcattggaatatcagggaaacatactaacagctgggttccacgtcctagagattttgacgtaatgacttttttttgtggtcatcaagacacagtcatagaaagacacagtcactgactaagagacagtggcaaagctaggaacaaacaggaaagaaataccctgaccttcctctcctactctctgatatcctgctgatgcctccaattagaagccagactatgagggagctgggggaatgcactctgcatggatcaacctcctgtagtctatgtagtggggaaaatgggtgaataaccagcacagagctcacaataaaccccacaaacagcctctgtccctcccacacacaaccccaggaattagaaggaagggcagactggcactttctcattaaggtaactcactcatgccatcttggcattgagctgggcacttttaggtggaatgacctcccgaagggctaaccccatctggcacctcttgacaacgttccttcttaatatcagtggctctcctgctgctggccaagcaggaccccaaggtccactgggatgtacatacttatggtattatgctctgcaatacttgtgggggctgtggaatgcacacttccaaagtgaaataggacattggaggttttatatataaatatatatatatatatttatatatatatttatatatatatatttatatatatttatatatatttatatatatatttatatatatataaatatatataaatatataaatatatataaatatatatttatacataaatatataaatatataatatatataaatatatattatacataaatatataaatatatataaatatatataaatatatatttatacataaatatataaatatatatatatataaatatatataaatatatatttatatattaatatatataaatatattactatgtatatttatatatatttatataaatatatataaatatatgtaaatatatatataaaaatatatattaatatataaaaatatatatataaatatatataaatatatatataaatatatataaatatatatatataaatatatataaatatatatataaatatatataaatatatatataaatatatataaatatatatatataaatatatataaatatatatataaatatatataaatatatatataaatataaatatatataaatatataaaaatatatatataaatataaatatatataaatatatatgtataaatatatatataaatataaatatatataaatatatatatataaatatatatataaatatatatatataaatatatatataaatatatataaatatatatataaatatatataaatatatatatatatatttttttttaatagagaggatgaagaccaaagcagtgagttccacctaagctggcccttgccttttgtctaacaggaaacccagtccttcctaatgggcacagaattttcagagaagagagcagaagttgagttggcatacctactgtagtgagggattttgaacaatgagctgtacattcctatatgggagccaaacttttagttaaatagtaatacaaaaatgctgatgtggatgccacggcttcctcctttcacacagaagatgggcagtgactacacatttaggttcaccttgcatgaagccacgctatagtttctaataaggtattattagtattcactagccattctccaagggttggcttcaaatgagatcagtaaagcagaagcaaatcacccacgggttctttcacagtttctttcaccctaagcctctcatttcactagacaactgtaggaagaaaaacgagatccctgaagggcagcaacttttcataaactgcacttgcagttttgccaatgcacatatctgtgggctcattgcacaggcagcgcttatatctatgggcacatttcacattgtagatttcttgtcctttctgattttctccccgatcacactgatacaggccacttccagtgcctctgtaaagctccaaggggtaaaggagggcaggggtgaggagtaaaggaacgattcttacaggtgttgtgaacacgactattttatatcaaatgcttctaattgaatagtttaacttaaaaacatgtatcacaaatacagtttgaccaactgtaacaatatcaaagcatattgaacaggaagtgaaagtctttgggtgtggatagagatttccagaaaaatatagttacataaatgtgagtttccaaattgtaaagaagaaaaaagacatatctggcttaatatatataacattaatatcatgcatagagattctattaataacatttgtcagccactattgctaagagctttacatccattttatcctcacatcaatactattaaagaggaactattattatcttcatacgatagatgaaaaaacaaaggctgtaagagtttaagaaacttgtccaaaatcatgtagctagaaagcggccaagccaggattcagaccttggttaacccacttacaaactctaaactcacttctccattgttaaacttgactagtgcattggcttacaatgaagtttgccatattcttccctcaaatctgtatttttaataagttgctaggtgatttttatggtcaggagaagtggggccatactacatgatgtaggctatttcctgagtatagataatttctttcttttcccttaggtgtccattttctaaaatgtggatgagaacactctctatgtgtcctgcaaaatttaaaaagtttccattttaaaatatgttttataaatactaaataacatgtccttttcttgctgcctaagacatgattattggtatgaaaatgctatgagaagtcctatagtaaagacatttttgtccagagaatctgacttttgtctttctccagagaaagcaacctgacttttgtcttttaccaaataatatctgtttgtgtatccttcagttgtgccctttggagagggctatttctccatgtaacttcatgcagttacaagtcctatgatagctttatatggatttataaatcagtaaatttttttatactgtaaaactttaattttaagatttcaatgtttttattcattttgaacatatagggtaataatatcttctgaagccaggcaaatctactattaaattttgctttctataaaaacatagttgttagataactaatactgtgcgaacaaatttcttttccctatagagaaatagtgagtgttgaaccgacggaccttgtctttagaataaaaagacttataaacacttgtaggccagctccatgagaatatgccagctggaggaattttagtgcttctaaagataactgagaaagcagtggctctgaaggttacctttttctgctaatggatgtttagatctaaaatcccagtttgctttaaaaaaaacagtagtatgttaagaaggtttctagacctgtgctatcagtgtcaatgtaagtcttataagttccctatgagaatgttaaatcacaagggcttagggtatataggagttaagtgatgctttcagttgatgttgaatttcatggtgactccagagtcacataatataggagcttccaagcttgacaaattgctcatatatacgtaggcagaagtggctgatcactacagtgctggtcctgggcctgtttggtttgtgtccattcttgtctttcccctactatgctgtatcacaggggaacatacctcccacaggctgcatttcccagcctcccatgtctgactgctaacagttgggtcaatggtaggcattgtcaggagattagagggcagaagaaaggagaagccagggaatttctgccttggcaacgtctctgcctccatgatgctatctcctgccagagaagcctaccaaggttccagcttactccatgtaaccctggtccctgtgctctggtgatgctacctcttctgtgtgccctttgtggtttcctgcctttggtaatccctaggttgactcactgctacttatttggcttttttttttctctcctattacctataaaccaacaccctgtgttaaattcccttaagttactcattggtttgtgttctcctggttgaaccctgattaatgaaatttccatttaaataccaaacgtttcctggagttcgttattctagtggaataacaaacaaccagctccatgaattgatggcttttcagaatttattgtctccacaatatttgtttcaaatcctcttttaataatcactattttaaaacttaattactactactattgataataataaatgtacccttaaatgtattatataccagatttggatttgcatctgtgtgtcatatgctcttagttcaactctttctttattgctcacctgaaataaagcttcttttgccagttctatttaattaaagattatcctgtgatgagaatgcaagcctaggttctgccttgatttatatggcactgctttttcttcaaacactaagtgatttgtagcaagttctcaaaaagatgtgcttgcaactttcattttctaaggaactggaaggcagccataattttctctttgaaagttccacctctgttagagtatgtatagaggtcaagttccaaaaatagcttcataatgtctgactcccctttaatgcagtttgattaatctttgtgtaggattcctggcaaatgataggcacaaaatgactatatatgaaatgaataaatgaatgaacaaataagtgaatatagcaactgtctctccatagttatgcatacaattagctattttttgactcaaaattaaccaggaaaaacttaagttatccttccacaaggtgaacttaactggatgtgtcttggtttgaaataccagcaaccagctgcatactgtaggagctatcagagcaaaactcaggtgttgacactaaagattaatgaaccacctttagttaattgatcacatccaaagtgcactcccttcagccttttgtctgtcagttggcagagggtccagcaggtagacacactccattgctcactgaaattaaaatttaggtaatttaaccttctcaatgctatagatgatgatttttttaagttgcagtggaaacaacagagcaatttctgggtgagtaggtcttcttggtgattcataatttagtagatgacatgttcaaatttattaagttggcctgagcataaaattgtccaggagaacaacagttaatctacaatgctgcagaggtatctttcaggaacaatacaatccccactactattacatattgggctttttaattttaggcttgcaggtaaagagtgagcttttcagtgtttgcttttcaatgatatacacgtgcaggagtaacaattctagtttttgaatgtgggtaggaaggcatgcctgagtgtttatccggggagtaagcaattttgtacatagaatgtaagttggataaatatgcatttgctttaggttaaggtgttaatgcaaccttgtcaagaagaataaatctgaaaagtggttaaatcaaagctatttgattttaaagaataaaagtaccatctttcaaacgatattatctttgtctaacagtaattttcccccctgcctgtaatttcagagctctgtgatgtggaagctgtcaatgttacgtaactgagagcaatctgacttctgtcattgtgtgcattcctcaaggatcgtgtttaggtggccctacttgatgcttttctaaaaagccccattctacttctaagtaaatactgagttcctggagaaacctgatgaaagaaggcataattttgatagctgctttgtaaatagtaggaataagtatgtggcattattttctttgagggagaagaaactttttatttgggtgcgattcatatgagaacatacttactgtagattttgaaccttgatactggcagtgtggattggcctgtaaattgatgcttttgtttctggctgaggaactgcaaatatgccaggtgacattctctttgaagtgtaaatgttgtttcagttgaattttttttctagtacacttggaaagtgagtttcatgcctatgaaagagtctggattctaataaacattattcctagacacaggaaagttgctataagcgatgggattttgaattctacatggattcctgtttaacaggtgacttcacaccttaaccttgaccagccttctatctacatctgccatgttgatttcttttgtatattcatttcttgttacttccagcggtaattacatttctaggatatattggtgtattttggttgtctccaagtccccttggattctgaggccaccattgtcctttctagacaaatggaatggcttaagcctccacacagtgcactttgggaggtcctggattgtacttgacatttccaaggtgtctaaaaagtctgatattgtggtgtcacctctttctccaaattcctgctcccagtttcatctttaatgaccgatggtcactttctgccctatcttgcaccatctgcctttaagacacccctaaggcttatacctcaatcacaactgatttttcctcaaagttcagtgaaggagagggcaatagagtgaagaatttgttgctgtcatccaaatataaaacaggaaacacattatattttaatataaaagcattattcctagaaacatattagccattctctgccaaaaggacattatcactgaccttatactttattaggcccccaaacccaaccatcttgagagggttccatctctctcccatatctttttcttttttctttctttctttttttttttaagagacaagttctctctttattgcccaggctggaatacagtggtgcaatcatggttcactgcagccttgaactccttggttcaagggatcctcctgcctcagccttttgagtagctgggactgcaggtgtgtgccaccacacctggctaatgtttcttattttttgtggagacagaatctcaaactctggagctcaaatgattctctcaccttggcctcccaaagtgctgggattacagacatgagccaccatgcctggcctcccatgtctcctgttccagattctagttccatactattggccactacaataagaaaatccttgttattttattaagcagatgacttgagctttcaaattctattccagcctagagtctagggcccaactttgcatactggactagaatcattaaggtgttttcccttttcccaaatgcaaatgtctttactttcacaaatggatcctcagtaccatcagaaaatttgaaattgctgtgttttcctttcaacatattacagatcacattctgatagctcctcctcaactcaataaagtaaacatcatggttacaggcagtgtgtgggtggtattggtatgtcgaaagtgggtgcagaatgagactgtatgtattgccatattgaactggagaagcaaaatatgttaaagcacctggatatctttctttgcatatctctcctgtggttcttggtcaaggactatcgttgatacaggaccagctatgtaagccggagggcacagtgcaaaattaaaatgtggggcccttgttcacaaattatcaggaactccaaaagatcacaacagagcactaaaaggtcacaacagagcaccaaaccttgagtggccctttctaagcacaggtcctgtgcaatagcacaggtcacatacccgtgaagccagtcctgtgttgatggttgttgttgagtgagattttaatacatgtatatttatagtctgagatgcatttgactgccacctttggagaaaatatgtgctagagtagaaaaaataatttgaatggcagtaacaaaagattggttgccttgagaagaacattcttttgtatccgttagagtttcatcagagaaacagaaacttctctagagtttaagttggaaggggttttatatatcaatgaagtatttctaaaactgttggaagtgttagaggatcaaagctcaaggaaagccgtcattagctttcagagaccctggaaagtgtaggaaacccacaaaatcattagtgatgtccaggcttcctgcagtgctgtgaaaggtgattttcaccaaagccgtggcgctgcctattcctgcacaggagcaatgggttgctgtcaacctctctccctctttctttatcttgcataaatcttcttgttgatgaaatttaaaatggtaaataagcatttaaggggatctgactgctacagctagatgggaaagccaaaccccttttctcaacaaggaataatttgaagaaattggattcttcattgttggtaaagtagtatctgccatttgcataaatatctaaattgtagagagcagccattattagttaaagtaaatgctacatgctataatagataaacactaaaatctcaatagcttaatacaatgagattttatgtctcgttcacctcaaatttaaagagcagctgggaagacggcagtaactgcaccatacaaccattcaggaaccagggctcatggaggctctgctattttttaagcttttattttagttcaggggtacatgtgcaagtttgtcatataggtagacttgtatcatgggagtttgctgtacagattattttgtcacccaggtattaagcctagtgcccattggtgatttttcctgatctctttctcttctcacactctaccctccgatatgccacagtgtgtgttgtttctctctttgtgtccatgtattctcatcatttagctcccacttataagtgagaatatgtggtatttattttctgttcctgtgttagtttgctaaggataatggcctccagctccatccatgtctctgcaaagaaaatggtctcatttctttatggctgcatagtattccatggtgtatatatgacacattatccagtctatcattgatgggtatctaggttgattctgtatctttgctatcatgaatagtgctacaatgaacatatgcatgcatgtgtctttatgatagaatgatttgtattcctttgggtatataaccagtaatagcactgctgagtcaaagggaatttctgtctttaagtcttcgaggaatccccactctgtcttccacagtggttgaactaatttacacttccactaacagtgtacaagtcttcctttttctcctcaacctcaccaggacctattattttttttttgactttttaataatgtccatcctgactggcatgagatgtatcttattgtggttttaatttgcatttccataatgatcagtgatgttgaggtttttttcatatgattgctggccatgtgtatgctttcttttgaaaagtgtctgttcatgtccttgcccactttttaatggggttgtttcgtttatttcttgtaaatgtatttaagttccttatagatgctggatattagacctttgtgagatgcatagttagcaaaaatgtcctcccatactgtaggttgtctgttcactttgttgatagattcctttgctgtgcagaagctctttagtttaattagatcacatttgtcaatttttgcttttgttgcaattgcttttagtgtcttcatcatgaaatctttgcccattcctatgtcctgaatggtactggtatacttgaaagagatagggggaatggaaccaacttggaaaacatatttcaatagatcaaccatgagaatttccccaacctagctaggaaggccaacaaattcaggaaatgtagagaaccccagtaagatacttcacaagaacatcatctccaaaacacataatcatcagcttctccaaggcagaaatgaaagaaaaaaatgttaaaggcagctaaagagaaaggttaggtcacctataaagggaagcccattagactaacagtggaccgctcggctgaaactcagcatacaagccagaagagattgagggccaatatttaacgttcttgaataaaagaaattccaacccaggatttcatatatggccaaactcaacttcataattgaaggagaaataagatccttttcagacaagtaaatgctaagggaattcagtgtcaccagacctaccttacaggagctcctgaaggaagcactaaatatggaaaggaaagactattattagccattacaaaaacacactgaagtacacaggccagtgacataataaaatgaccacataaacaagtctgaaaaataaccagctaacaacataatgacaggatcaaatatatacatgtgaatactaaccttgaatataagtgggctaaataccccaaatgaaaagccacagagtgtcaatctggataaagaaagaagatcatagatatgctatcttcaagagacccatctcacatgcagtgacacaaacgggttcaaaataaaaggatggagaaaaatctaccaagcaaatggaaaacagaaaaaagctggagttataatcccagtttctgacaaaatggactttaaaccaacaaagattaaaaaagaccaagaagggcattacataatggtaaagggttcaattcaggaagaagatctaactatgctaaatatatatgcacccgacacagtagcacccagattcataaagcaagttcttagagaccacagagatacttagagtcccacgcagtaatattgtgagactttagcactccactgacaatattcgacagatcactgagacaaaattaacaaagatattcagatctgaactcattactggatcaaatgaacctgatagacatctacagaactctccactctgccattttcaactcatggtttctgcagttgttgtgagcattgacactagttggcagaaagggaaagagggagagtggaggattttatggcaaatttttatgggctaaacctcagagtggcacttgtcactttttcccacattgctattgccaagttctggtcatatgaccccttctaattgcagaggaggctaggaaaattagctacgtgctcaggagggaaaaaaagggtaaacagctagacagtttctctcacatgatgtctgacagggatccaggttgcccttctaccatttcagtaatcagagagtcatcattcacgaggggaaaatggctagtggtatgaatagcttttggtattttattaaacctctttgcttctaagtttctagatctgtaaaatgagggtaagtgcatcttataggataattttgaggattttagatttgacacaagtaaaatggtttagtgtaatacctgaaaattagcaaaaaatataggaatattacccattatcattattattttcatcactaagtgacttagtttgttttcacactgtggtaaagaactgtccgagaactgggtaatttataaaggaaaggggtttaactgactcacagttcagtatggctggggaggcctcagggaacttacaatcatggctgaaggggaaggggaagcaaggtaccttctttacaaggcagcaggaaggagaatgaatgcaggaggaactaccaaacacttatgaagctatcagatctcctgagaactcactcactatcatgagaacagcataggggaaactgcccccaagattcagttacctcaacctggtctcccccttgacacatgaagaatatggagattacaattcaagatgagatttaggtgggaacacaaagcctgacaatatcacaaaaactctaagaaagggtagcatatttggaaataagttaatatatcaaatgtgctcaacgcatgcacagaatgtagtaaaagttcaatacatgtttttatcatctaaacttattgagtcttcctggtattatacttacatttattattatgactttctactcataagaacccctcagataaatttcattttcttttattaggtttctttttagaatattgtctgtctgcaactacagtcacttggatacatcactaggtttacatgtgttttaagtcgacttttgctagatgtagcttgatctttgaggctctgtgtaggcctttataaattgcccttcatttgtttattgagaattgaaatgaaaatggaatgctccagactcagatgatgggatttgaggtggaaaatctcattaatgcataaacatgtaaataaatcagttgtttctaaaaatttattcagggccgggtgcaatggctcacacctgtaatctcagcactttgggaagccgagacaggcagatcacctgaggtcaggagttcaagaccagcctggctaacataaaccctgtccctactaaaaatacaaaaattagccaggtgtggtggcgggcctctctaatcccagctactcaggaggctgatgcaggagaatcgcttgaacccaggaggcaggggttgcagtgagctgagactgcgccattgcactccagcctgggcaccaagaacaaaactctgtctcaaaataaataagtaaataaaaataaaataataaaatacaaatttattcaggatagcatattaaacattgattgatgttggtactttaacagataagaactattttaattttgtgttcaattgagtcaaccctaatttgtttagaaacttctggaattgaatgcaatctgttaaaagtaaagacgtgttaggccagataataatattgctttaagcttgcctatctctaacacttattaggagaatatatttatatctgtctttttaaagtaagtattgaaacagctttgtttaattctcttttggtaagaaagatttctttcataacatttgcataatttttaaaaaaataattgtacaaaaatcacagaaccagtaaagaaatatctgtgacttgagggtctcaggaaggcagtatcaaatggagattcatttatttatttatttatttatttatttatttattgaggtgctgtccttttttaagagtgtatttgttcctctttttgtaaactgcagacaacttgaactgatggtgaggtctggtaagaaaaaaaaaaaaaaaaattcaaagctaccaagggagaaaaggtgaatttcattggattactaaattcacaaacaaactttataggtcatcattgaacattttatttatattagaataagcaagcattgagcaagatagaaataattttgcttcaggttatcatcattgtgaactatcacaaggtataagcacagaaatgacagaagttctggcacagaacaaggaatttgcacatggtccaataacatgaacaaaaaaggttgtatttatttatttatttatttatttatttatttatttatttatttatttttgagacagagtctcactctgtttcccaggctggagtgcagtggtgcaatcttggctcactgcagcctccacctcctgggttcagatgatcctcatgcctcagccttctgagtagctgggattacaggtgtgcgccacaacccctggctaatttttgtatttttagtagagacagggtttcaccatgttgaccaggctggtctcaaactcctggcctcatatgatctgcctgccttggcctcccaaagtgctgggattgcaggcatgagccgctgcacctggccaaagtttcatatttcttgtgatgacactgaatttttagacaaaagagatatattgactttgtgtgttgatggtttcaatttagaaaagactatttgggctgggcgcagtggctcatgcctgtaatcctagcactttgggaggctgaggtgggcggatcacgaggtcaggagttcgagaccagcctagccaacatagtgaaaccccatctctactaaaaatacaaaaattagccaggcgtggtggcacgtgcctgtagttccaactacttgggaggctgtggcaggagaatagctttaacccaggaggtagaagatgcagtgagcccagactgtgccattgcactccagccttctagtctgggggacagagtgagactctgtctcaaaaaagactatttgggaatttgttcatcaaaatttatgcatccactttattttctcaaagttcctcttactggaaagcatttaagtattttgattctttttaaaaataatttcaacttttattttagatttggggggttcgttacatgggcatattgtgtgatgctgaggtttggggtacatattatcccatcacccaagtagtgagcttagtacccaataggtagtttttcagcctttactcttctttttctcccctctctagtggtcccaatgtctattatttccatctttatgtccatgtgtgcccagtgtttggctcacacttataagttggaacatgcagtattttgttttctgttcttgtgttcattcacttaggataatgacctctagttgcatccatgttgctaaaaaggatataattttattctttttcatggaggtatagtattccatgatgtatatttaccacgttttgtttattcagtcatctattgatggccacgtagatggattccatgtctttgctattgtgaatagaactatggtgaactttttggtataacaattattgtcctctggttatatatccagtattgggattgctgggtcaaattgtagttctgttttaaattatttgagaaatttttaaactgctttctacagtttagaaattgatctaatttacactcccaccaacaaagtataagcattctcttttctccacagcctcaccaacttctgttctgttttgacattttagtaatagtcattctgactggtgtgaaatggtatctcactgtggttttgatttgcatttctgtaataattagtgagggtgatctttttttcatattttttggctgctttatgtcttcttttgagaaatgtctgttcatgtcctcgtttcactttttaatagggttgttttttgcctgttcagttgtttaagttacttatagattgtggatattaagtttttgtttaatgcatactttgtgaatattttctcccattctgtaggttgtctgtttactctgttgatagcctcttttgttgtgcagaggtctttagtttaattaggtcccacttgtcaatttttgttttagtagcaattgcttttgaggacttagtcatgaattctttgccaaagccaatattcagaatggtattaccaaggttttcttctaggacttatagtttgaggtcttacacttaaatctttaatccatcttgagttactttttgtatatgatgaaaggtgggagtctagtttcattcttgtgcatatggctagccacttatcccagcaccatttattcggtagggaatcctttctcttaatggtttttgtcaactttgttgtatgtcaaatggttgtaggtgtgtggctgtgtttctgggttgtctgttttgtttcactggcctatgcatctgtttttgtaccagtaccatgctgttttggttactgtggtcttacaatatacttaaaagtcaggtaatgtgatgcctctgactttgttctttttgcttaggattgctttggctattcaggctcctttttggttttgtaagaattttagaatcagtttttctaattctgtgaaaaatgatgttgataatttgttaggaatagcagtgactgtgtttgggcagaatggccattttaaggatatatactcttccaatccatgagcatggaatgtttttccatctgtttgtgtcatctgtgattactttcagcaggcttttgtagttctccttgtagggatctttcacattttggttagctattttcctaggtattttatttttcaggtggctattttaagtaggattacattcttgatttggctctcaggttgaatattattagtgtgtagaaatgctactgatttttgtgcattgattttatatcctgaaactttgctaaagtcattgttcaattctaggagacttttggtggtgtttttagtgttttctaggtatagaatcttacatcagtgaagagagacattttgacttttttttcctatttggatgccttttatttctttctcttccctgatagctctggctaggactttcaatactatgttgaataggagtggtgagagagggcatccttgtcttgttcctcttcttaaggggaatgcttccagcttttgcccatttagtgtgacattggctgtgggtttgtcatagatggctcttgttattttggggtatgttccttcaatgcctagtttcttgaggtttttttgttttgttttgttttgttttatcgtgaagggatgttggattctattgaaagctatttttgcatctattgagaggatcatatggtttttgtttttagttctgtttgtgtggtgaatcacatttattcatttgcatatgttgtaccaccctttcctccctggaataaagcccatttgatcatggtgaattaacttttctgtatgctgctggattcagtttgctagcattttgatgaggatttttgtgtctacgttcatcagggatattggcttgtcgttttcttttctcactgtgtctttgccagaatttggtatcagagtgatgctggctccatagaaggagttagggaagagtcccttttcctcaagtttttagaatagttacactggctcttcttttgtacacaactttataaacatacctgtaagcgtaattttgcaaagatctttcattcatcaaagagaattcctttgtgaagtaaaatggtaaatagtctaagcatcttgctttcaacttgactcagagccaaatgtgtgtaagcattgagagggtttgccattttacattccttagtctgaagaagggaagaaagagaacatccttaaaccctaaaaatattacttggcctgtatggcatttgtacgcaaaggtagaatctgagaccttgcataagatttactggaaatgctacatctccatgaaagactacatcaagagtgtcaaagcatgattagttggggcacattcatatttttttgttagggagtctatgtcctctcttttatgtattgtttgacgtcagatgcctttaaagtaaaactataagaattattagtcatttgatgagaagtaataaatgttatatagagaaacattacaaaatagagatagactcaggataggggaccatagagcatacaaccatgaacacatatcatttgcttaaattagttaaaacacaaaagcaaaatatttgaaatagtcaaaagaacattttcaattctacctaataatttattggatgaattcttttatttttttaaatagtttactggccgagttgataatatgatctatcctagttattaaccagcagaattttaatttagttttcaaggttctccatggtctaaactcaacatgcccttccaggctcaaattacactcttccagttcaaaggcccatctgaaatgggctgcttctattatgttgcccaggctttcttatctctagctctttgccctgatacctttgtctttctacttggagtacctattctttccatctttaataccccaccttcattaaatgaccctttctaattacttcctgcatgcttcagccagatgtaatctcttctctctgattatcacataacactattttgtgcttctgtggttttcaccttactcatctctgttgtactgacaaatggactgtgagctccgtattttttatcttcacccttatgcattgcgtaattaaaaccttgtacacagtacaggttcagcaaacacacactgaataaattaataagtaggtgaatagttttgttgtttacattcactaacaacccattctgattcatgtttacatggacagaaaaagaatgagttgattattaactaaatttaatgtatgtcatctgtatacctaaattctttgggttaatattaaaaaagtattcttccaagttagcatgaatttgacctatcttttagagtgttcagattggttcactcatgttgacattagtcagttttgaaattcagacataaaggtatacacatatagatttgacatttgagattaacttacttttttccagttagattatggaagagataaacaatgactcagaggaaaatggagaggctatagaggtgaaatactgtaataatgtggctaaacttgcttgagagaagatgagacataagcctgctttgttagtcctttcatagagaaatgactcagcactgttagagaatatgatgaggttacattgttctttcatcacaaactgttgagttaatggtggcatatatagagtatagctctgattcataagacaattggtcattgtgcttctctctttttattttttaaagcaaattagtgctttaaaagagcatagtaatctggttcttttcatgaaaactgatgattaaaaacaaactacgaaaataattttaaatacacctgggtttccaaatggacagaggttgttgaaagtcatttttaagttccttcaaagctacaaagtctatgtgtttctcaaattatcttttgcaaatcttagtaggaattaaacttgtgcaaatccaacccctggctctttttagcctcgtgagagcagagtatgcatcgtgctttcgttttggatgagaaatatacaaactgtgtgttgactggtggaaagcagaacaatggatctcagcaaattgtatcatgcccagctctgacttgagacgcagaatcaattcattttcagtgtcatgacaggatctgagatagaagtgagtctcttgttgccatcatgagaaaagatacgtatgtccacagttttggggagagggagcatgggagctgggtgcttcactgccaacacagcctctgatcacctgatatgttacaaaatcaattttatcttctgctgcatttcatgtgacaattcaaagagcaacatttgtttttctactctttacattctcaacttccatggaggcataattgccatgagttaaagctaggaggagagtgatcactgcacactgatttggatataaaatctatggccatttgaaagggaaaccttcaagagcccacgtaataaatccccgaggaacttaagagagatgaactgtacctaattgcatctgacatggctaaaacacagggacctctctaaagagtgtgagggcaggtccccaaatcctctgctcagcactattcaaggttcagaagaattcatgcatttagcttatctacagctatgtggcaaaacacccttcagctgcagtcagcctccctctaatgaccaatgaggagaggccaaaaattaaagttgtataatcagagattttaaagacaaactgaaaagaactggtggaaccgtctaacttatgccttggaatggcatgcattattttgtatatgattttgggcctcagaacacaaacacaactccctccacaaaggggatgagtttgctgggccagagtggcctcttgttgctgggagctactgccgcccagcgtgggcagctgcaatcacagtgcccctatccctgcctgagtggtcctggagggttggagagctgcgtgactcctcaagacctttgtcactagcctgtgtaatgcctgtgcatgagtccttgaaagcaaatcccccaattagggcctacatggcctaccctgaggagggaagaggtgcaatacatgttgcttttaacaattcttcatcaggaatgagaggatgttgcaatggaaaggaaaatattaattcctgctaggcccttgtcagtgggatcttctcccattctcttcctgctggaattacagatccataggttttggagccagtcagcctgggttctttcatgcattcccttcttctggtgggcttgaccatactagatatcaaatactgtgactcaaagttctaccacctctgttgacttaaaggtcaaacctagaacaagccttggtctctaggtctaagaggcaaaataaaagctggtgaaccttcttactgacaaggcacttgacttccctgtgcctcagacttcaaatctataaaacgagactcactgttcttatctctgaggtttattgcttggaattgaatggggtaattcataaattccctagcctggcaccccacacacggcctcttcaagaagtttcggggtagctctcttgccagtcagctgagaaaaccaagcagtgagaagagggtcatatattgacttggttttcatgctgacaggctttggcatctcctcaagcttgtccatactctacagtggcattaagagagtagtgtcctgcacttgtgtttgagcactgtggaacattcctcaggagttctggctgagatgcatgtgccccaccttttcccagaaccagggccctctaagtctaagtcaataaagggaccaggggaagttcctggaaattctgatccaattcaagtccctgctacctaggtttacctcttgcctggcctgtctccccctaatttctcaggagtagacttctatttgtatagtgtttatatgggccaacatttgcatatgttcacgcatgttatcttcacagcaattctaaaaagacaattaactcttgttatgtctgtttataaaagaggaaattgaggcacagaaatgtcaagtcacatgaacaaatccctacaggaaccatctttaataagtgtcaaagtaaggagtcaagctcaggcagtcatgcccttatcccacaaattttgagattctgccatagccaggtttatgccttgcttctcacttgtgatggactttccagagcttggcccagtcactgaaacatggcaaacattgtcaatatttgatgagtaaagacatgaatgaatgatgcttttgcaactatcccattccctgtgcactcactgaatttttcttcccctttttatcatcgcagtgtttgaaaattttacttccttattttactagatatatctttgtctttacatgtgtcatctctcaaccagatgtaaaaggtacttccctgaagggaagaagcatgttttatacctgttatgtaacctccgtaagaatagctgaatactcagtttgtgacacacaaaaaccctaaaataactatctaaatagattgggaagttgggttgttgagatacagaagatttactcttcttcccaactcatcccttctctttgctccttccaataaaatgctatttggttgaatagtttaaagatggaaaaccatttaaggttaaaacagatgaataagatcattctaaagaagcagaaaggcgttcagaccgttaagttgaatagatcagagtacggcattgattctggctgtaagatttcaggtcaccaaaggaaatatgttggattgcattatctccattttttttaaaaataaagtttagatcgctccctgaagataaaattactcttggaactatattcaagaaggacttaagtatgtagaccttatgtaacagatgtaagaaacaattccaccaatgctgatattatggagacaccaacatgccctcttacataagccataaaagtggtgagaatggccacatttttgtgatggggtgtttggaattaattcatcttcatgaaacagaggccacatcatattcttggtcatgagtaatgatggtaatactgtttctctttcctttgaatcacttacctatccattgacctaacatgttttaaataccacaaaggagtaagattctctctcatgtctttgggtagagaaatatgcaacaacccatttcctaaaaagtctgtaattacatgtgggaaatgctggtaattaatagcctgaatgggtgattctaagttagattcatgaaaaaccaagagacatatctaacctttcttaagctccagggcacatgcataatttgaacattatgtctacaatgtgggtgtattttcttccttttcaatgaagacagtgattaggatgataatagaaataatacttgggtttatagagcctttagctgaagtctacctacatggtttctggctctgtggtaagcatgtcggactaatgtcagcttttgaagtgaatttttcatgcctttttccctctgggcttcccctttctctaataaaactactttaatcccattcacattccagttctgaatactagcacttgaaatgaactgtctatatctgactcacttaaaaaaaaaagtagtttaaataaaaacaaagagttgtttactttcctttcctacctggctgcatctgtcacatgcatatagtgtcccctgacatgaagctctgatattgatctggagccttattgatctccaacttaatatagggacaatgtctaccaataacttaggcacttccagagaggctcactctgtcttcttttgttcacttacaaaatgaaaagaatgtctttactagagtacctattaaagggttccagtacaccctaccacaagctcaactttggaatctgataaaatattttttaagcaagcttctggttttgttatattaatttgggattggattccctccagtggttcaaacaaaatgaaagtatgatctttaagtatgtaatatattctgtcagttctctggttagtttggatcagaattaactcctttcaggatcatcccaaaataacagtgtaaccccatagtaaagcacactctcttctttcctgtgatatcccatggagtaggaataattaggcaaccacaactgcttaaccctgtgtggtttcacacagaaaaatcatgacaatttctcttcttgttgactctttctcatttttctggttatccatagcttttaacaacaaaccaccctaaaagttattggcttaaaacaattgcaattatttatttggttcacaaatctgcagtttgggcagggctcagcagaaaaggcttgactgtgctccaggtggtgtgagctgtggtggctcaagtgggctgaagtatctattttcaagatatcttaccaacatggctggtgctggctgtttcctgggaactctactgggtctgttgtatggggtcattgattctttggatccaagataccacagctagaaactgccactctttttcagtctggtacagcatcacttctgcgatattttgttggacaaagaagtcacaaattctgcccaaatttaagaggaagggacataggacctgtaaagcaaaataaaatgttaagcccccaaccaactaaatggatccccctcacaaccaagagcattccaaagttaacctgaaacatgagttcaggccatgatgggaatggatagtcagacatgcctcattataccatcctccctttggaattgaggcacaactgaccagcgttaatattgaaacagaaacgttaaaacaatctgttctctctgaagcctggaggcttcatctgtgtaataaaaaccttggtctccacaaccctttactttaacccagacactcccttctattcattccaggtatttatcaagagcccatctaattgccagtcagaaaatctttgaatccacctatgacctgaaagcactgatcccctactgacccaacttccatttgtcctgcctttccaggacatggaacatacatcttaatgtcaaaggcatgtccttaaccttggcaaagcaaacttctaaactgattgagaactgtctcagatactttttggtttacaaaccctacctgtcattgagaggagtgtcaaaaaattgggccatgtttatactacatgctctttaattaatatctgtctgatactactaatatctgatactatagttacccaagccagaaactcagtcatcacctttgaccctttcttctctcttatctttctcttcttgacccaccctagaaatacatgtaatctttattgcatataattaataattctgtgacttaatcagatattattgtatcatatacataaataccaattacaaagtcttctaattgaccctagaatcttctgcttctcttgagtgccatcacctctactctggtacacacatcatccctcctctacctactagccagtctctctgcctccagccttacccctttttactctagtcatgatgattttatttttagttagaaagaataactgtcctctgattataatttctcaaacatcctctattgctgtaagagtaaagtgcaaatttgtttgcctggcttccaaggccctgcaggatggggtcccagcctccttcactagccacaccttgttatctcctattgaacctttggcccttagccttcagctttaccaaaatcttgatgtactccaaatctcttcctttgaaatgctctttcctgttcctcttccttcttaccatcctccattccctttg

SEQ ID NO: 1198 - DNA, 7435 bp, Homo sapiens
gccacattgatttaattcgcaaatttgcattgtaatatatgatattgaagatgttctgctaggatgctcacaggagcacttggccagaagttaggaggggaacaatttgtgggcaagcagaacgctgcatccatgctctgggcggaagcttggagcagataagatgcactttttttttttattattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgctcttgcgatagtttactgagaatgatgatttccaatttcatccatgtccctacaaaggacacgaactcatcattttttatggctgcatagtactccatggtgtatatgtgccacattttcttaatccagtctatcattgttggacatttgggttggttccaagtctttgctattgtgaataatgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaagtgttcctatttctccacatcctctccagcacctgttgtttcctgactttttaatgattgccattctaactggtgtgagatggtatctcattgtggttttgatttgcatttccctgatggccagtgatgatgagcattttttcatgtgttttttggctgcataaatgtcttcttttgagaagtgtctgttcacatcgtttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccaattttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggcccttttttggttccatgtgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaactgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaaaagagctcctgaaggaagcgctaaacatggaaaggaacaaccggtaccagctgctgcaaaatcatgccaaaatgtgaagaccattgagactagcaagaaactgcatcaactaacgagcaaaatcactagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctgaaaataaaaggatggaggaagatctaccaagcaaatggaaaacaaaaaaaggcagggagtctctgataaaacagactttaaaccaacaaagatcaaaagagacaaagaaggccattatataatggtaaagggatcaattcaacaagaagagctaactatcctaaatagatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaagaattgaactcagctctgcaccaggtggacctaatagacatctacagaactctccaccccaaatcaacagaatatacatttttttcagcaccacaccacacctattccaaaattgaccacatggttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcagtgaatccaggagctggttttttgaaaggatcaacaagattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagatgttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattagtcaggagaaggaaataaagggtattcaatgaggaaaagaggaagtcaaattgtccctgtttgcagacgacatgattgtatatcaagatgcacttttattctagcttcctaaaagcaatggcccttgatggcaagactgaaggactgctgagcacttgagaggagacccagtctgtggacatgcctttctgactgatgtaccctggtggtggttttgtttttccttgtctgacttcactctgaaaagggcgctaatttcaagcgatgagcaagtcatatcaaggctacccatatggcagagacagcaaactttactaaaatggtggtttgtccctttctttattgttatttttttaattaaagtttgaagttgttttctcgttttcttacatccacattttcttccatgccctgccagtggatgagatggagtcacagattttggagctgatgtcttccatgagtcgtggctgtgtggtggtgaggtcggctgctgctggtgctgtccagttttgaactgacttgagcgttgtggccggtgtagcagtcagccatagactaggggaaccttggtgtatgtgtttttatggtttcctttagcattgttagttcaaaagtatgtcacctattcagaactggttatttggttatttcagaactccaaatcttacaaagtctaatgaaaatcttacacaatcttacacagtttagtaaacaaaacacacaaggccagagggacaaatgtacctcagagctggggctctgagtcctgcccacttttcttgtgaatgagcttcccactcgaggttggcttgctcctctttctaataattctaacaagtttaacgggttttttattgtggtataatacttataacatgaaagtcattataaagtgtgccagtggaatttatgttttattatattaatgatgtttcgaccgtcagcactgtctagttccagaagtttccttttgggaagttttcatctccccaaaaggaaactctctacccatcagcagccaccccgctgggccccttcttcctggccccaggccaccacaacctgctttctttctctgtgaatttgcccactctggagatttgatataagtggaatcatccgatacatggccctttggtctagcttcttttacttcgtattttcgaagttcatccaggatcatagagtatatcagaattccattcccctctatagctgaagaatgtcccactgtatggtatttccacattttgtttatccattcatctgctgacggacattgggctgtttccaccttttggctcttgtgggtagagctgcacttaacatttgggtacaaacatttgcttgaacacctgtcttagattttgggtgtatacctaggaatggacttgctgggtcacgtggtcatcctaggtgtacgttattgaagagccgccctatgttttccacagcagcccttggatttcacttttatctacagtaatgcggaagaagggggctgatttgtgacaggtgggcaaatctgcagtgttaagaagaggcaggagacagggaacccatgcaatccacatacttcagaggcaggtggtgctcctggctcacactgtaggtaatatttgccctgtgcctgtcagcttcatctgtgtgcatgggctgagctgggaagaaccaggggacctggaaaggggttagggagcttgtctatgccagcatccttgacaccggcatgatatcaggatccctattcctcttcacaaggcccaggccttaccccaaacctgctgtacatccatcccaaggggggaggctggcatctgtgtttcttgctgcatttatttaaatgcagttcagcctaatgcacagcccgggatgagactgcaggtgaagtgtcatattttaagatgtgctcatgagaggcatggatacaaggccaggcctccctggctgacatttgggtgcttgccatgggccaggccctgccctccttgctgggtgagcgctgtaccagttggtcatcgcaatggtcttaagcatcactgaggaagacattgaggcccagatagggactgtccttggccaaggcctcctagccttgagtaggggccccggccagcagtggggctcactgcctctcaggctcaacatcccagggggatgggaagaaaacattctgggagatgagtggagagagactgattctctgtaggtgatggcatgtgccttgagctgaaaggtgcttccggtttctttgtagcgatggggtcagctgctccaggcagctgtggcagcatgagtgaaacagaggggcttattccagtgcatgtgggggagaggagggaggtgggctcagccagagcagagggatttgaagagtggcagtggaggagatatttgaaaggtgtgttgggacccgtatgcagggtgccgtgtttggactttgttttgtagggcacaagacagttgaaggctttggaactgggaggaaagtgacaagaaggagtaccaggctgtgggacactggacactgagaaaaggaagaggctatgggggaagagaggggccgtgagacccggggcaagtgtggacttgggggacacagtagcggaaagcagcaggcctgggcagtcacctaactgcaggtgccaaggtcgtggtctgtgtcccgggagaccagcgggtgggtgtccagagatgggggcaccagaaccatgtgggtcatgtatatttaatgctgcctgcttgagaaagcaggggcttggcatatgttttaggagaaagttttatttcttgaaatggttaaactgataaatcctcagttatcccaaaggctcagggttccagaaaatggctccgttgaagggtgaatcccatagatcttataagagtgattgtaaccctgccttggtatagccagggagcagagatagagggtaggaaccagattgccctggggaaagcaggtcagcctgaaacggcatgacctttgatgtcacctccgtgcaggaatgaatttctctaccatatgaatagcaccatcaactaatacatttttattattcctgccacttcataaatagtgtctccatcttaatttgcatgtgtctgtcactctccatggtctttaaaggtttgtataaacttgtaaattaatcctcctttacatgcataaggcaaaccagct

SEQ ID NO: 1199 - DNA, 1986 bp, Homo sapiens
atggaaatgaatttgagcagtcttttcattagagcacacttggtctaaatgagtttggagtggttgtaatagccattcctgcactgttatttataaaggtgaaatctgatgtgagtatttttgttcttacgctactgagaaacaacatattgcttagagttttcaaacttccatgtgatagttgctcttgctccccgaagatcctctcagggaagttatttacgacaaggagtcccatagaatgggaatccctcagtgaaagtcaaccaaggcctccgattagtgagtagagcagataaaggcctctcgttgtggaaccaaaatgggaagaggcaatggccaaagtgagacaccttctttcccaagtgcaagaggcactcttgcttccatagtgaaagaagtttgcgagatgggtgtatctgatggctatgtttccaggtggagaactatacatttacttcaacattttaaacattctgttaatgaatatgcacatgtgtgcacgcaaacacacacacacacacacacacacagagagagagctatgggaatatgctgcaaaaatctctgacttcagggaaaataattgaccaaggcccccagctgctgcactctgaaatctgtcactgtgccaacaaggccacactccccccagtgactgcgagcagcaggggaactcaggcaggcccatttctgggagacacagggctcctcaaatttaatccccaacagttttaccaaaccatccttagagtacaggggaatcaaggatgaatttgcccaactttgttcactgttctttacttggggtcagacttacatcacagtttcttgtatttttctctcataaaatacttgcacatttaatcccatcttggcaatggcttcctagaggatatacatgtgtgtgtgcatatatatgtacatatgtgacagtatgacacacacatatatacacacatacacatatatatttatatatatacacacatacatgtgcataagtatatatatatatgtatatgtacctttgaatcataatttatctccatttgatgggcactagttaggtccaaatttttgccgttataaaaatacccatctatcccatttttctaattatttcacatttctttggggagatttttttttaagcttgccacagtgactgtgactgtcctttgttggaatacctccaaagaactcccagagccaatgccacacttaacacttgttttccacatgtatagattttctggtgtggcttcaatttctctggtaaatgagcttcaggccttctcatgtcagtgtgcagagtaaagaagtgaggatctagcctttcacaggatcctctgcaaggcagtgcagtaaggaggggaagggttttctgccacgtctgtggtctcttcattcttctcttcctgctgtcattctcgacctgggccctgctgtccttctctcatctggtatccattagagttcttgattacaagcaacagaaatggattctgcttcacttcaaccagagagaagttgtcaggaagatatcgggggctcacaatcaatgggcagctggaggatcagtcttgaaagctccggggctgggttgcaggaacatagtgaggatcttttactagaagagcctggtgagggaacctccaggataaatgggctccaggggatcttggtccttgcttcaccttcccaagattcaaatcctgggaaagagacacccacagaggcacccctaaggcagagggagactctaatgcctgcagcaggcgggcacctagaacttcactccaccaacacagaacctgatggattggaagtaattcccccaaatacactggggagatttgggaagaggaaaaaaaatgttgggctacaaaatataatagtaatatctagcagcacccttttatatatgtgcataatccttgagtttgtacatgttcggagactggccacaactgttgcatgata

SEQ ID NO: 1200 - DNA, 5924 bp, Homo sapiens
tgtgcacaaatgtcaaattaaggttcaaaagttgaactggaattgtgaaatagccatctgttcattttaaagaaaatattaactagtaccaattctatgaatctattccaaaaaatcaaggagactcctctctaacttattctacaaagccagcatcaccatgataccaaaatctggtgaagacacagtgaaaaatgaaaactacaggccaatatccctgatgaacatagatgtaaaaattctcaacaaaatactagcaaaccaaatccagcagcacatcaaaaagtcaattcaccacaattaaaaaggctttattcctaggatgcagttagttcaacatatgcaaatcaatatatgtgatcatcacataaagagaatgaaaaacaaaaaccatattatcctctcaataaatgcagaaaaaacttttaataaaatccatcatgccttcaagaaaaaaaccctcaacaaactaggcattgaagaaacatacctcaaaataataataacagccagctatgacaaacccatagtcagcatcatactgaatgggcaaaactggaaggattccccttgaggacagaaacaagacaaagatgcctactctcaccacccctattcaacatagtactggaagtcccagccacaggaatcaggcaagagaatgaaataaaaggcatccaggaaggaaaagaggaagtcaacttatatctcttcatttatgatatgattctatacctagaaaaccctaaagactcaaccaaaaggctcctagaactaataaaaaaagcttcagtaacatttgggttacaaaatcaacgtgcaaaaatcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaaaaagtcatagatgacacaaacaagtgggaaagcagtctatgctcatggattggaagaatcagtatcattaaaatggtcatactgcccaaagcaatctacagattcaacgcttttcctaccaaactaccaatgttatttttcatagaattagaagaaacaattctaaaattctataaaaccaaaaagagcccgaatagccaaagcaatcctaagcaaaaagaacaaagctggaggcattgcattacccaatgtcatattatattgtaagcctacagtaatcaaagcagcatggtagtggtacaaaaacagacacatagaacaatggaacagaaaagagaactcagaaataaagccacacacctacaaccatctgatcttcaagaaagtctacaaaagtaagcaatgggaaaagggctttttattcaataaatgatgctaggataactgtctagccgtatgcagaagaataaaactgcacccctttctttcaccatatgcaagaatgaactcaatatagattgaagatttgaaagtaagacatcaaacaataaaaactctagaagaaaacctaggaaatgccattccagacataggtcttggtaaagatttcatgatgaagactccaaaagcaatcacaacagaacaagaattgacaggcggacctaattaaggtgcttctgcacagcaaaagaaactatcaacagagtaaacaggcaacctagagaatgggagaaaatatttgcaaactatgcatctgacaaaaatctaatacctagaatctataagaaacttaaacaaatcaacaaaaaaaaaatccctattttaaaatgggcaaaggacatcaacagatacttctcaaaaaacacacaggtggccaacaaacatatgaaaaatactcaatatcactaatcattgcagaaaagcaaatcaaaaaccacagtgagataccatctcacaacagtcagaattgctgattaaaagtcaaaaaataggctggatgcggtggctcatgcctgtaatcccagcactttgggaggccaaggcgggcggatcacgaggtcaggagattgagaccatcctggccaacactgtgaaaccctgtctccaaaaaaaatacaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacacaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaaacaaaattatcattcaatccagcaatactattactagctatatactcaaagaaaaataaatcattctaccaaaaagacacatgcacttttctgttcagtgctacactattcacagttgcaaagacatgaaatcaacctaggtacccatcaaaggtggactggataaagaaaatgtggtacacctcatatacaccatggaatactatgcagccataaagaagaccaaaatcatgtcctttccagcaacttggatgcagatggagttcattatcctaagcaaattaacacctgaacagaaagacaaataccaggagtcctcacttataagtgggaactaaacattaggtacacatgggcataaagatgggaagagtagacaatggggactactagaaaagaggaagagcagggaaaacaaggactgaaaaactgcctattgggtactatgcttactacctggctgatgggatcattcataccctaaacttgagcatcatgccatatatccatgtgccccctgaatctaaaataaagttgaaattacaacaaaatttttttaaatgtttaaaagatattctcatagaaataatagtgatacccagtaacaaagacttctactttcttatgttttttatttgtacaaacgtgtaagccaacggtcctatttgaggaagcgttctaaaactaaatacagaagtgaactatacgttattttctgagaaggggaataattaagttgtatgcatgttattcgtatcacatctaaatggtaataaaaggtatagtgtatggaaggctaaaattcagagaaggaggaagagagaataagtcagtgaccttttagtaataatgtgaaaatatagtttagacactcggaaatatttctctgacattaagggctttatcatacatggaattgtaacactgcagtctttcccagaggtcttctaaaatagtttataacccaatctgtccggtcatggtaattttatttataatggaaaacaatctaaatgactaataagagggaaatggataaattgtggtatatgactctggaacatttaggtagccattagtatttaattttacttaaattttaattttaattaaagtatgatagctaagtagcagcatattacaattcttatggtaggatactcagtgaaaaaagaattcacaactttatagtatgattactactctttaaaaattaggtatgaatatgaattaagattgaatgagaacccagaacaataaacatgattaatggggttacatggtatcattgtggggaaaaaaaaaagttttccagttatttgtgtgtaacaagtgaaagcatatattgttaaaggtgttcgtctctttcaaagtgtaactgtggacaagaagataaactgacagactcagaaagcccccttcagtctcaagactcctaaattgctgagttgcaaggaggcagtgcccagagaatgcagcattcctaagcatcactagtttccattaaaacctaatttatggaattaaaaattaatttcatggaaatgaatttgagcagtcttttcattagagcacacttggtctaaatgagtttggagtggttgtaatagccattcctgcactgttatttataaaggtgaaatctgatgtgagtatttttgttcttacgctactgagaaacaacatattgcttagagttttcaaacttccatgtgatagttgctcttgctccccgaagatcctctcagggaagttatttacgacaaggagtcccatagaatgggaatccctcagtgaaagtcaaccaaggcctccgattagtgagtagagcagataaaggcctctcgttgtggaaccaaaatgggaagaggcaatggccaaagtgagacaccttctttcccaagtgcaagaggcactcttgcttccatagtgaaagaagtttgcgagatgggtgtatctgatggctatgtttccaggtggagaactatacatttacttcaacattttaaacattctgttaatgaatatgcacatgtgtgcacgcaaacacacacacacacacacacacacagagagagagctatgggaatatgctgcaaaaatctctgacttcagggaaaataattgaccaaggcccccagctgctgcactctgaaatctgtcactgtgccaacaaggccacactccccccagtgactgcgagcagcaggggaactcaggcaggcccatttctgggagacacagggctcctcaaatttaatccccaacagttttaccaaaccatccttagagtacaggggaatcaaggatgaatttgcccaactttgttcactgttctttacttggggtcagacttacatcacagtttcttgtatttttctctcataaaatacttgcacatttaatcccatcttggcaatggcttcctagaggatatacatgtgtgtgtgcatatatatgtacatatgtgacagtatgacacacacatatatacacacatacacatatatatttatatatatacacacatacatgtgcataagtatatatatatatgtatatgtacctttgaatcataatttatctccatttgatgggcactagttaggtccaaatttttgccgttataaaaatacccatctatcccatttttctaattatttcacatttctttggggagatttttttttaagcttgccacagtgactgtgactgtcctttgttggaatacctccaaagaactcccagagccaatgccacacttaacacttgttttccacatgtatagattttctggtgtggcttcaatttctctggtaaatgagcttcaggccttctcatgtcagtgtgcagagtaaagaagtgaggatctagcctttcacaggatcctctgcaaggcagtgcagtaaggaggggaagggttttctgccacgtctgtggtctcttcattcttctcttcctgctgtcattctcgacctgggccctgctgtccttctctcatctggtatccattagagttcttgattacaagcaacagaaatggattctgcttcacttcaaccagagagaagttgtcaggaagatatcgggggctcacaatcaatgggcagctggaggatcagtcttgaaagctccggggctgggttgcaggaacatagtgaggatcttttactagaagagcctggtgagggaacctccaggataaatgggctccaggggatcttggtccttgcttcaccttcccaagattcaaatcctgggaaagagacacccacagaggcacccctaaggcagagggagactctaatgcctgcagcaggcgggcacctagaacttcactccaccaacacagaacctgatggattggaagtaattcccccaaatacactggggagatttgggaagaggaaaaaaaatgttgggctacaaaatataatagtaatatctagcagcacccttttatatatgtgcataatccttgagtttgtacatgttcggagactggccacaactgttgcatgata

SEQ ID NO: 1201 - DNA, 6848 bp, Homo sapiens
tctcagtggcacaagaaataattttacacaatcaaggacatcatagattaataaaccagtatttttagcaacatgttagttttgtgttttatgctccttttcttgctctcacttcaagcaaagacgtccctcaccatctttggagcaggtttcccctttgctcccctttctcctggcccctcccaccccagcacagtcaatgctaattaacagctgtttaattatcagcccagcagggaagtgatcatggcccaggtcctcagagagttatatgcacagttaagttgtcccagatactggaagattgactgtgttatgtgcccatagggagaggcaatgcggcttagtcgaaagttcatagcattgagaatccatcaacctgatgactctgccatgttttaactgttagacaatggcttccaaacctttttttcctcaaccgtaacaataccaaccccacagttttgttgggaagattaaggccaggcgtggtggcttatgcctgtaatcccagcactttgggaggccgaggcgggtggatcacctgaggtcaggaattcgagaccagcttggccaacatggtgaaaccccatctctattaaaacaaaaattagccaggcatggtggcgaatggctgtagtcccagctactcgggaggctgaggcaagagaatcgcttgaacctgggagtcggaggttgcagtaagccaagatggtgccactgcactacagcctgggtgacagagcaagacttcatctaaaaaaaaaaaaaaaaaattaatgtagtaaaagtaccttgttaagtatacaatcatatgcaaatgcacagggatgttttctgcttcatcttagcatggtcataactggcacatcatagagagactagaggtgggtaagggatgggtagagttgcttgagcaacatttgtgcacaaatgtcaaattaaggttcaaaagttgaactggaattgtgaaatagccatctgttcattttaaagaaaatattaactagtaccaattctatgaatctattccaaaaaatcaaggagactcctctctaacttattctacaaagccagcatcaccatgataccaaaatctggtgaagacacagtgaaaaatgaaaactacaggccaatatccctgatgaacatagatgtaaaaattctcaacaaaatactagcaaaccaaatccagcagcacatcaaaaagtcaattcaccacaattaaaaaggctttattcctaggatgcagttagttcaacatatgcaaatcaatatatgtgatcatcacataaagagaatgaaaaacaaaaaccatattatcctctcaataaatgcagaaaaaacttttaataaaatccatcatgccttcaagaaaaaaaccctcaacaaactaggcattgaagaaacatacctcaaaataataataacagccagctatgacaaacccatagtcagcatcatactgaatgggcaaaactggaaggattccccttgaggacagaaacaagacaaagatgcctactctcaccacccctattcaacatagtactggaagtcccagccacaggaatcaggcaagagaatgaaataaaaggcatccaggaaggaaaagaggaagtcaacttatatctcttcatttatgatatgattctatacctagaaaaccctaaagactcaaccaaaaggctcctagaactaataaaaaaagcttcagtaacatttgggttacaaaatcaacgtgcaaaaatcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaaaaagtcatagatgacacaaacaagtgggaaagcagtctatgctcatggattggaagaatcagtatcattaaaatggtcatactgcccaaagcaatctacagattcaacgcttttcctaccaaactaccaatgttatttttcatagaattagaagaaacaattctaaaattctataaaaccaaaaagagcccgaatagccaaagcaatcctaagcaaaaagaacaaagctggaggcattgcattacccaatgtcatattatattgtaagcctacagtaatcaaagcagcatggtagtggtacaaaaacagacacatagaacaatggaacagaaaagagaactcagaaataaagccacacacctacaaccatctgatcttcaagaaagtctacaaaagtaagcaatgggaaaagggctttttattcaataaatgatgctaggataactgtctagccgtatgcagaagaataaaactgcacccctttctttcaccatatgcaagaatgaactcaatatagattgaagatttgaaagtaagacatcaaacaataaaaactctagaagaaaacctaggaaatgccattccagacataggtcttggtaaagatttcatgatgaagactccaaaagcaatcacaacagaacaagaattgacaggcggacctaattaaggtgcttctgcacagcaaaagaaactatcaacagagtaaacaggcaacctagagaatgggagaaaatatttgcaaactatgcatctgacaaaaatctaatacctagaatctataagaaacttaaacaaatcaacaaaaaaaaaatccctattttaaaatgggcaaaggacatcaacagatacttctcaaaaaacacacaggtggccaacaaacatatgaaaaatactcaatatcactaatcattgcagaaaagcaaatcaaaaaccacagtgagataccatctcacaacagtcagaattgctgattaaaagtcaaaaaataggctggatgcggtggctcatgcctgtaatcccagcactttgggaggccaaggcgggcggatcacgaggtcaggagattgagaccatcctggccaacactgtgaaaccctgtctccaaaaaaaatacaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacacaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaaacaaaattatcattcaatccagcaatactattactagctatatactcaaagaaaaataaatcattctaccaaaaagacacatgcacttttctgttcagtgctacactattcacagttgcaaagacatgaaatcaacctaggtacccatcaaaggtggactggataaagaaaatgtggtacacctcatatacaccatggaatactatgcagccataaagaagaccaaaatcatgtcctttccagcaacttggatgcagatggagttcattatcctaagcaaattaacacctgaacagaaagacaaataccaggagtcctcacttataagtgggaactaaacattaggtacacatgggcataaagatgggaagagtagacaatggggactactagaaaagaggaagagcagggaaaacaaggactgaaaaactgcctattgggtactatgcttactacctggctgatgggatcattcataccctaaacttgagcatcatgccatatatccatgtgccccctgaatctaaaataaagttgaaattacaacaaaatttttttaaatgtttaaaagatattctcatagaaataatagtgatacccagtaacaaagacttctactttcttatgttttttatttgtacaaacgtgtaagccaacggtcctatttgaggaagcgttctaaaactaaatacagaagtgaactatacgttattttctgagaaggggaataattaagttgtatgcatgttattcgtatcacatctaaatggtaataaaaggtatagtgtatggaaggctaaaattcagagaaggaggaagagagaataagtcagtgaccttttagtaataatgtgaaaatatagtttagacactcggaaatatttctctgacattaagggctttatcatacatggaattgtaacactgcagtctttcccagaggtcttctaaaatagtttataacccaatctgtccggtcatggtaattttatttataatggaaaacaatctaaatgactaataagagggaaatggataaattgtggtatatgactctggaacatttaggtagccattagtatttaattttacttaaattttaattttaattaaagtatgatagctaagtagcagcatattacaattcttatggtaggatactcagtgaaaaaagaattcacaactttatagtatgattactactctttaaaaattaggtatgaatatgaattaagattgaatgagaacccagaacaataaacatgattaatggggttacatggtatcattgtggggaaaaaaaaaagttttccagttatttgtgtgtaacaagtgaaagcatatattgttaaaggtgttcgtctctttcaaagtgtaactgtggacaagaagataaactgacagactcagaaagcccccttcagtctcaagactcctaaattgctgagttgcaaggaggcagtgcccagagaatgcagcattcctaagcatcactagtttccattaaaacctaatttatggaattaaaaattaatttcatggaaatgaatttgagcagtcttttcattagagcacacttggtctaaatgagtttggagtggttgtaatagccattcctgcactgttatttataaaggtgaaatctgatgtgagtatttttgttcttacgctactgagaaacaacatattgcttagagttttcaaacttccatgtgatagttgctcttgctccccgaagatcctctcagggaagttatttacgacaaggagtcccatagaatgggaatccctcagtgaaagtcaaccaaggcctccgattagtgagtagagcagataaaggcctctcgttgtggaaccaaaatgggaagaggcaatggccaaagtgagacaccttctttcccaagtgcaagaggcactcttgcttccatagtgaaagaagtttgcgagatgggtgtatctgatggctatgtttccaggtggagaactatacatttacttcaacattttaaacattctgttaatgaatatgcacatgtgtgcacgcaaacacacacacacacacacacacacagagagagagctatgggaatatgctgcaaaaatctctgacttcagggaaaataattgaccaaggcccccagctgctgcactctgaaatctgtcactgtgccaacaaggccacactccccccagtgactgcgagcagcaggggaactcaggcaggcccatttctgggagacacagggctcctcaaatttaatccccaacagttttaccaaaccatccttagagtacaggggaatcaaggatgaatttgcccaactttgttcactgttctttacttggggtcagacttacatcacagtttcttgtatttttctctcataaaatacttgcacatttaatcccatcttggcaatggcttcctagaggatatacatgtgtgtgtgcatatatatgtacatatgtgacagtatgacacacacatatatacacacatacacatatatatttatatatatacacacatacatgtgcataagtatatatatatatgtatatgtacctttgaatcataatttatctccatttgatgggcactagttaggtccaaatttttgccgttataaaaatacccatctatcccatttttctaattatttcacatttctttggggagatttttttttaagcttgccacagtgactgtgactgtcctttgttggaatacctccaaagaactcccagagccaatgccacacttaacacttgttttccacatgtatagattttctggtgtggcttcaatttctctggtaaatgagcttcaggccttctcatgtcagtgtgcagagtaaagaagtgaggatctagcctttcacaggatcctctgcaaggcagtgcagtaaggaggggaagggttttctgccacgtctgtggtctcttcattcttctcttcctgctgtcattctcgacctgggccctgctgtccttctctcatctggtatccattagagttcttgattacaagcaacagaaatggattctgcttcacttcaaccagagagaagttgtcaggaagatatcgggggctcacaatcaatgggcagctggaggatcagtcttgaaagctccggggctgggttgcaggaacatagtgaggatcttttactagaagagcctggtgagggaacctccaggataaatgggctccaggggatcttggtccttgcttcaccttcccaagattcaaatcctgggaaagagacacccacagaggcacccctaaggcagagggagactctaatgcctgcagcaggcgggcacctagaacttcactccaccaacacagaacctgatggattggaagtaattcccccaaatacactggggagatttgggaagaggaaaaaaaatgttgggctacaaaatataatagtaatatctagcagcacccttttatatatgtgcataatccttgagtttgtacatgttcggagactggccacaactgttgcatgata

SEQ ID NO: 1202 - DNA, 112414 bp, Homo sapiens
ttgctttaagataattttattttgcatagaaacttatactttaaattagaaattatacttattagcatattttattgacagtattatcttataattttaaaatatctttattgtgattttattttcttaatgattaaaatttgatttatgttcgagttctcttcttgattacaatttcaaaatacttttcttatcattcattttttcttatacattttataaacagtacattatattgtgcatagtgttttgtatactgcttttgatcaattaagttctttaaacaccattaattttacttgtatatcataattttcctatatgtggtgtttttttggggtaatagcctcattggtatataattcacataccatacaattcacttatttaaggagtacaattcaatggcttttaggatgtatacgaaggtaagaaaccattaatacaaccaatttcaggagattttcattactcttaaataaacatccacactcattatttcaatgcttgcataccattgaattatgcaggcacagtgtggttactaaaatattctcaattattgaacaattagattatttatacattatgatattgttcccaatacatagacatgataaatattggatgtgatgtgaaccccaaatacattgacttgatcattacacattctatgttggtaaaaaatatcacatgcatcctataaatatgtataaatatttctcaacaattttttgaattaaatattctgatgaacattcctgcagccaaactttgtgtaagaacgctatgagcatacgtgcaaaaactaccagatatataccaaaagccttaaacatctggtaacttttcatggagaaataccttccttctagatcattcaaccatggctattagcattttttaaatggtaaacattagaaaagtcatgttatatttgtatattattttgccttccttcaggtgataccaagtggaatattttttatattttgattagctgttgtggtttattttctgcctcagaagtatattaaaagttttttgtttttgtccttttcagtttttgaaaataaccatgtcttttgtaactgttttgtatcttatttcagttgctgctctgtcttctttttttaattaaggcaatattagccttatttttccgtgtttttaatgacaatgcagttgtgtttttacttttttagaaatgatattcctagtttcttaggaacttgtttttcatcaacagtggtaattcatcaaattggtaatgaaatttatcaactgaatttttagtatctttccagattaccattgattttacttgatgatatatgttattacatttattgatgttaagccactttgcatgttaagcgtaaaacctttttctaaccaacttatatttggatgacataccattgtgttttattttctagaattctcatatctatattcaaatctcattgcagtttttgtgttatatttctgttttttaatatacaggtatttcttgcttggcaaagtgattagcatgttttgatattttttctattgtaggagagtttggtttagaattcataatttcttgaaagtatggagatatttcagtgtaaagttgtctggcttttcagattattttgagctaagtatttgacataattgttttttaattttttttttttttttttgagacgaagtctcactctgtcaccaggctggagtgcagtggcgcaatctcgactcactgtaacctccgcgtccagggttcaagtgattctcctgcctcagcctcccgagtagctgggaccacaggtgcatgccatcacgcccagctaatttttgtatttttagtagagacaggatttcaccctgttggccaggatggtctcgatctcttgatcttgtgatccgactgcctcaacctcccaaaatgctgagattacaggtgtgagccaccgcgcccggtcctatctgagataattttgattttaattttaattcttttgaacttctattttagataggagggtatatgtacacgctcattacatggttgcattgcacccagatagtgagcatggtatccaacaggtagtttttcgacccatgacgtcttcctcttccctctaaaagtccacagtgtctattgttcccatgtcataatttttatttttttcataagtataggttgattcacagtttagaagttttctattttttgttttgacatcctgtggtttcctagaaaataagtcatattttctagatttccaaattcattagcaaggagtaatacatattttctcatacaatcaatagttattaatacagcttcttgctattcctgatttatttgtattttattatacattatccattaagcatgacagaggttgctgtagtttgtcttttgaaccaatttatagctttaaaaataaattaaaatatattactattgtacaaattgttaattcatagtttcattatttttatttacttaaaagtacagattattttcattatttctcagtaaaaaatgtagtgatgctacatgatgaatttaattttggcagtttcggctgtagtccatgttttagtgaaaatctttgttttataatcctcttgatatatatttagaatcagtttggaatgaacatatgactgattgagaaatgaattctggaggaatgaaaccaaagaatacacgttattcagtatcatatatattttcatttgtggttaattggtacgattccaataacttcagagctagagaatgtaaaaataatattgcagtgttacacaatcaaattgagatggcatgaggattaaaatctttatgataaaaacacaaacacagaaacaactctggcttcatttttatgtcatgtgtcttaacctggggtttaataacctaaaaaataaatctggataccacatcaaagggctttcaacgagctctacaaaatgacatcctggccaaaattagaggttttggtttaaaaagggtggaaaataattgagggtgtggtgtgtgtgtgtgtgtgtgtgtgtgtgcaaatagataaatataagccctttcttttattttggtatcaatgctagtcctaggatactttctcagagacctatgacaaagtaactttggaagtttaatcatttcttacaaattattttttcagaaaattgacgtttgagttacaaaaaaacattaaacattgctctagtaacagcatgtatattgtcttcacaaaatatttaatgccaaaacgataatttatggagagaaaaattgtattttcttccaagcatgtgtagtgagtgtttcaaaggtaatcatgaagcataagataaactaagaaaaatgcatatactgataatgtatttatataggaaataaataatgataatacaaatttacaaagctgagaaaattaagggaatgaattgtgtctgtttttatttgaaaagactattatagttagttgagatgtaagggttgaaatatgattgctatgattcttatacttatcagaataattttacagatgacatagcatacaattactagtataattactactcactccaggaaataattgaagtcatttattaattttgagattttttttccttttttccaaaacattatcataagagtttttccatctttatatggacaagtgtattcagatttttctcgtttttcagataggaataatatgtgctaggcacacaactgataacaacaacaaaaaaataaaaacatgacaacaggactagagtatatctacccatgtgtacaaatgtgcctgtgatatgaagggtgaagtatttgccaaccaaatggtaacttgccttctaaactagattcctttcaaatccaatacttcccctttatactgacatgttggttacctacattcagaggaatattgtatatagtcatacaactagtattagtcagtcagcatgctaattataatacaatcatctatgtggtgaaaactgctgatgtaacatattcagctctgtccacgtggggctttcatgcttttgggtttgatgttccctacatctaaaatgtcctggaatcgacaaactagccttagaataatttctcatctttcaaatctgactttacgtgccgtttcacctgtgaagaatttaaattttttggccaatcttaatttgccaaagaaaattgactatgctctctccttagtcttcaactgtgccctggcatggctaaaacttaattgaacgtacttatttttgtaatgataaatcctttgaagtcaaatgccatgttcacttgtttcgattcaacattcccaacacattatctcaaatattatttattgattgaataaacgattaaatgaataaatgtattaatgaatgaatagaaatcaacaagtcaattaagttaataagctggtcagatttgtcacttacacctcaaccacctcaaagaaattggctattaccttcaaaagatgaaatatgagcttctttggaagttacacgagaaaacagcatacttggttgttttcttaggaatgtgtcacaatcatttcattatgacaccaacaacatcaaattgggctctcaatttgcatttaagggattgacaaaactaggtgtattacaaagcttcgcatgttggctgagttgtaaggactcaaaaacaataaatgggttcctaacatgaatttaccgtaagacccagaaacttctcctctttggttaataaccaaacaaagcaaaatgaggtattcaaactaatccctctacatgaataattatagcagcactgttcacaatagccaaagggggaaaacaacgcaaatgtccatcatcaactgataaatgaaaaaacaaataatgaatttcatacaatatcatgttgtatagcgatgaaaagaaatgaagtactgatacatgctacactatgaatcttcaaaatattgtgctaaaggaaaaaagccagacacaagaggtcccatattgtatgtttttatttatatgaaatttaaagaataggcaaatctgtagagacagacacagaaagcaggttgatggttgtcaggggctgaaagaaatggctgcttactgtgaacagagtctatttagggttgttaaacaattgttagaactagataaaagtggtggtcatacagaattgtgaatatactaaatgccactaaattgtatactttaatacagttaattttatgttatgcgaatttcaccttgattaaaaaaatacagatggccgggcgtggtggctcccgcctgtaatcccagcactttgggagcccgaggcaggtcgttcatgaggtcaggagtttgagaccagcctggccaatatggtgaaaccctgcctctactaaaaatacaaaaattagccaggcttcgtggcacacacctaaaatcccagctacttgggaggctgaggcagaagaatcgcttgaacccgggaggtggaggttgcagtgacctgagactgtgccactgtactccagcctggtccacagagtgagactccatctcaaaaaaacaaaaaacaggccaggcgcggtggctcacgcctgtaatcctagcactttgggaggtcgaagcaggtggatcacctgaggtcgagagtccagaccagcctggccaacatggtgaaaccccatttctactaaaaatataaaaattagctgggcgtggtggcgtgtgcctgtaatcccagctacctgggaggctgaggcaggagaattgctggaacccaggaggtggaggctgcagtgagctgagattgggccactgcactccagcctgggtgacagagtgagactacatctcaaaaaaaaaacaaaacaataacaacaacaacagcaacaaaaaaccatagatgtggctataggggaaaaatcaatgaatatgaggatacaatgaactcatatgggattaattgatgttatttctcttttctttattcactttactaaattcatgtttttgtctaatcttctaagaatcatgagaattgatctaagagtttactgattagaaaattttcccaaaaggaaaaaagatacttatgtctttgttttaggagtagcttctgcttagaaaataaatgtgaatttattacttaggtgtcagagtgtttattttaattaggaaagaacctgtctgtctctgaacactgtacagcttctttttaaaaagccaaaattaattacatatgccactgtcataatacgtaatataacctattgactctagaatttgagttgttagctctgtcttataaataaatataattttattgctcaatgctttttaaagtgtgaaaggggccattgatgtcatattgaaaatgcctataagatgcttttacatctgcaatctacaaagagacattgataatgggaccataaaagaatacttgtgaagctagtccttagtgccactgactttttgcagtagttgtgagcatggttctatgaaggatttgatatatgttgttgcttaagtagaagggtccatgtttcacttggaattaattcagccctttctcttacagaggagcctctgcttctgttctgctctaatgacagcattctcattagaaagcccagaggggttctttaaaaatgtaaatgagatcacattactgggactaccctcaaaaccctccagacttcccatttattggacagaaaagtttaaaattcttacagtggcttgcaaagccttttgcctctgacctcatcttctattgctctgtgttccagagattttggcctctatgctattgattgtgtatactaaacatgctcccatctcaaggttgtcacatttgctgtttctactgcgcagaatgttcttctagatatatttgcataactcagtctcttaatttcttcaagtctctgatggcatgtcaccttattatgggcgttttccctaactattttatttaaaaacagcaaattctccagcacttcctatttgttattgttttattttctccataatagtcatagccatctgacatattacgtattacaaattttttacatttattgtctgattccctcatctagaatatcagctacataaagccagaaatatttttgtctgttttgttcactgctgtattacaagcacccagaaataggcctgcccttagtaggcacttagtaaatactggttgagttaatgacctgctcggtaagtggtgattcattcaatctaaagagtctgatgattcattcctgcctgtctttagttatgagtaatatttttgcccctggtaacttcctctctgtaatttctttttgaaattcctattagtcacatttatccaatatgttgtcacttttttttttgtcttttgactctatttttttaagagacagcatcttactctatcacccaggctgaaatgcagtggtgcattcacagctcaccatggcctggaactctcacgctcaactgttcctcctgcctcagcctcctgagtaactaggactacctgtgtgtgccaccacccctggcaattttttttaaatttttgtagagacaggatcttgcgatgttgtccagaatggtcttgaactcctagcctcaagcggtcctctcaccttggcctcccaaagcactgggattacatgttgaaccaccacacctggccttttaactctattttcaagagatattcttgattatatattttattctttctaatgacttccaacttttaattggtgatgtttaatttctatacattctcatttgttctattacatttgcttttatataaaatcctgtccctttttattgatgaaattggtatcatcccaaatatacttgagtagcctaattatattttgctttcatacttcttccttgaattgtatgtatttctcctagtgtaaaatattcaatttaatccttatgctctttctattttgtacaatttttttcaaatatgggtttatctttgatggttagtcattttgtaaaaatcaaggcctaggctgactatttgtagagcagattgtttccctaataggtgccttccttatctgaaagggaagagttctgtgtaattgagtaagtattgtagcctactcaacttttcttaattgtgcattggaggattggtgaataaccaactcactctgtttcttatcacttcataattaattgaaacagaatcgtgtgtgctgaaaaccttccaatgagcctaactttcccaggctgaacatattattattattgttattattattttgagacagagtctagcactgttgcccagggctggagtgcaatggcgtgatctcagctcactgcaacctctgcctcccgggttcaagcgattctcctgcctcagcctcctgagaagctgggactacaggtgcgtgccaccacgcccagctaatttttgtatttttagtagagacatagtttcactatgttagccaggctggccttgaactcctgacctcgtgattcgcccgcctcagcctcccaaactgctgggattacaggtgtgagccactgggcccggtcatgaacacattatttctttagagaacagtcttttggtagtaagcactgggatgcttctgtataaaccggaatggcaagtggccagtgtggtcagatgcagccattccttttatgttcctttaaatattcaccttctgtgttggtacttccacctgcacatcttccagttctgactgtctggtattccagagctgtgttaggaggattggcttccacctcaactgtcagtagcactttcagactggcttctttcacttaacaatatgcatttaagattgttccatattttttcatggcttgatagcacatccctttttatcactaaagtattctaccgtatgaatgcaccacagtttgtttattcacctattgaaggacatgttggttgtttccaagttttacaaatataaataaagctgttgtaaaaattcctgtgcagttatttcccagctttattgagatattaattgacaaataaaaattgtacgtattcaagttgtatgtgatgatttgatatacatatgcattgtgtcatgatcactacaatcaaattaatcaacacttccataaccacacataggtatgctgtccgtgtgtgtgtgtgtgcgtgtgtgtgtgtataaggaggtgaggaaacctaagatctactctctcttagcaaatttcaagtatacgatatgatattatcaactctagtcaccatgctataaattacatcctcagaacttcttcatcttatacctgaaattgtgtacccttttaccattatctccacatttcccttaggctttcaggtttttgtgtggacaaacgttttccactcatttgtgtaaatatcaagaagtgtgaattattgaattgtatggtagcgctatgtttagttttgtaagtaactgacaaaatgtcttccaaagtggctatgccatcttggattcccaccaacgatgattgagagctcctgttgctctaaatccttgtgttttaatacaattttgtaaaagtattatagtccaagaatacgaaatgtgcccaatatagaaaattcaaatttatccctaatcctattaaaaaaactattttctgctactatgtgtgtatttatatatacacagtcatacagtgtatatatgtttgctttctgcctttttcatttaaagacacatcatcaaagaataccatgtttttgcacactcttcagaagagcacttttttttgggggggtgggcaggcagggagatggagcctggctctgttccccgggctggagtgcagtggcgtgatatcgactcactgaaacctctgcctttcaggttcaagcaattctcctgcttcagcctcctgagtagctgggactacaggcgcacgcttccatgcccagctaactttttgtattttagtatagacagggtttcgcggtgttgtccggctggtctcaaacccctgagctcaggcaacccgcccaccttggcctcccaaagtgctaggattacaggtgtgagccaccacgcctggctggggtagaagagcacttataatggtagattaattctgcattatttggatttgctacaattgaatagctatttctccattgtttggaattaatgtggtttttaattacctcatcataaataacaatgagatcaatgtacttgggcctgttagagtcctccatctaaaaattggttggatttcagaatatgctcaagtgcttagcacttttaagttttgaaagcaggaaataaatgttaaattaacatttaggaagttagaaaaggcccaaaatgaggatcacggaaaacccatatatgatacctactttgacccggtattctaagcacgtaattggtattaactcaagtaatgctcacaagaatctgaggagactttgaagcattattagcccaattttacagctaatgaagttgagtttaagtaacttgcttaaggcattgtacctagcaagcatgggattgatgattcaaatctatacagcctggctctaagcaatggtcttcacagtttcactccattgttgagagaacatttgacttgcatgatttaaggtagaataaaaatcttgatagggccatatagatctcattatgtcctctagtcttacatatggtctattgtctctttagattacctgtcctacatgtagaggcatttgagtttgcagccccatggcaaagtaatgaaaaacctattggttatgaggtcactagtgcagcctaacaaagacatggcccagctgcttatgttgcaagtgttggaaaactgatcaattttctaacatcacttccctaaaaatacattttggtgtgtggatgaataatgctgaataaataccagatagctatgtatactcacagttctgaaaatacatgatccccaacacaattttagttgtgccttggtgcagacgaattttttcacttttatttctctgagaaactattttaaacccacaccaacctcattaatttccacatcaaacaatagggctttgactatcagcagatgtttatactatctgttagccataaaaatttaggacactactcaaattgtaggtaacaaactaatggctctttttgcttgtcattatccaacatttttgttgaaagacccaaagtcaaagaggatggtccatgaactaaatgaattacaaatccatctaaggccaaaacagaagaatgtaattttaaagatactgagcctatgcttttacaacctgaactccctacaaaaatgtgaattcttatgaaagacaaataaaaatttattttcatagcatagattaggaaaattatgcacattttatagattatagacaaattaatatccactttataataggttatggcttactaaataagtaatgtttaatttaaaaattcaaattgtaaatactcaataatatttaaaatatttgtatactttttttttttgagacggagtctcgctctgttgcccaggctggggtgcagtggtgcaatctcagctcactgaaagctctgcctcccaggttcacgccattctcctgcctcagcctcttgagtagctgggactacaggcgcccgcctccacgcctggctaattttttgtatttttagtagagacggggtttcaccgtgttagccaggatggtctcgatctcctgaccttgtgatccgcccgcctcggcctcccaaagtgagccaccgcgcctggcccaaaatattcgtatacttaaaatagtagtcgaggctaggcgcggtgtctcacgcctgtaatctcagcactttgggaggccaaggtgggctgatcacaaagtcaggagattgagaccatcctggccaacacggtgaaaccccatctctactaaaaaaaaaaaaaaaaaaaaaaattagcatgttttatgactttgtttatgttctggttgcatatgtacattcactttaagaaagttattctagctttacacttatgagtcttgtacttttctgagtagatactgtatgtagttcaataaaaatatacttcaaacaatatatttctaagggaaaagagttctgaaatataacataaccattttgacatactaaaatatatactccatgaagcattacgttaactgcaatatagacacacacacacacatatatatgtatacacatatatatgtatttccatgtgtagatataaattgacataatctatgattgagtcatacgtactcagacaggcatggtggtgcgtgcctgtaatcccagctacttgggaggctgaggcaggagaattgcttgaacctgggaggcagaggttgcagtgagccaagattgcgccactgcactctagcctggcgacagagctagactccgtctcaaacagaataaaaataaaaatgaatagtcactgtttaacctttcttgtccagtttttgtgtttttaaaacatcctgcagaaatgtgtatctttccttggggttgcgggggtatacctgtgatatgtggctttttaaaaaagcttttgctgcttttttttttcccctttttttggagagagagtctcactcggttgcccagactggagtgcactggagcaatcattgctcactgcaaccacaaacttgcctcggcctcttaaagcactgagattacacgagtgagccactgtggaaggacaagctgcttttatttatgcatattaatttctttatcacacattttatttttaaaattatttctagtgtcttgagtttaatgttcattttttatttttcatccattattttttcaaatatgaaagaactcaacactatgaattgtccatggagtataaatttggttgccttttatagatttttataggtaatattctaattatttcattttattaatattttctaatggaagttccacattttccaattttgcttgagggttgcttataaaagttttgtttttatggttgtttattttcacatctgagaatgttttgtttttagttttgtgcataatttataattgggtaaactcttctgcaacatcatctctacctcctaccttgcatgctattctatagccaatcattttcttttatatttaccaaatatctcttaaatgcaggccataagtctgacacctcactaggatgtaataatatacatgaagcatacagtgtatctggattcaatgatcttacaatgttggtctagtggcatacagtaaacaaataagagcaggcatggtaaacatattgagatcatatatatataaaagttgagtggggtcacaattgagagaccgtgagatttcagagaaactcttcatagagatgaaagatgagaagagttttgaggggagaggtatttacctagtagaaaatatttggatggaaactttctgaatagagaacaacattctgtattctaaaatctaataactttgtagagggctccttcttcttctgtatgatctcctattctgtgctctttatcctgtcttacttccatctcacacagatacaatttttcattcactttctcttcttattttaaactttttccttctcactcaactctttccttccaaatttatgaatatatccagacggcactcattctaacacacatgtacacacacattcctcctcttaactcttcatcctgttcagctcttgctcttgcccataatcagaactttctgtcatgattttctcattgttcttgcttttctcaactcatcataatgtgactcttatcccaggaatggcaggaagttatttcgctgagatcaccactgacgatctaattgcaaaatctaatgggcatctttcattactcttacttttggaggcacacgatcatattatgcacatatatattgccgacacaatcccgatattatctggattaagattgtttgcatgtatgtcccttaatagactagaaaaatgtgagggtaagagatattatgtattatctatctttgatctatctttgtagccctaatgtttagatcagtgcttagtacataatagacactaaaaaatttagtgaactcagtggtgccagcaattattcagatattgagttctcctggggagattctttgtgatgtgctgatgcatttaggtcaactctgtccaattatcattttcatgtcctagagtcattctaaacactctagctcctgagcgtatgtattactttaatgatatctttaccaatgctttggtgtgttagtctattcaggcttctattacaaactaccattgacaagctgttttacaaacaggaggaatttgtttctcacagctttagaaaaccagaaagttcaagatcaaggtgccagcagagttagtgcctggtgctggccacttcctgcttcatagacagcattttttgttgtgtatccacatgacagaaagggcaggtaaatatctctggagcttcttttttaagggcactgatcccattcatgaagactctactcttgatgtaattatctccaaaaggccccacaaccaaataccctgacattggggattaaatttcaacatacagttttttggtggaatgcaaacattcagaccatagcaactgacataaatatgttgaatcattccctcattcaaaaggggttttccatctaatggatgtagatgttatgagtagagaatcagagaccccactgctgtggaagcagaccctccaaattagggcaatttttctactggaaggttttgaaagcttcaacaggccacaatagtttcatttgagacaaactctaattccatgtaatatatgtgtaatgtgtgatgtgcaaagtgtgtttgtgtgtgtgtgtctgcgtatgcatagacacatccgtgcatgtctgtttatctcatagggatcttggttttacacccaagaaaaaagtatggcttctcttaattctgcttcttcttaccagcccttagaattcaacctgcttcctgtcacagaaaggtatatgactatcttaaaatatgattttattagccccctttttctctattatgatcttggaaacttgtcattattattcagattagctttactactgtattaatgagataattaatgtatgtaaggatgtatgtgtgagtgtcagtgtgtgggtatttgcatgcataattttgtttttttcttgaatttcactgaacagatttgtcatttacatcatttggatacataatacattccatttgtgtaagtgttttttttttttttttcatcttttgaaaattaacaatggctatctggagccaaagattttaccagatagaaataaggtttctctttattatagaattgacattttcaatttttattataaaaagcaaattgaagtctttaattgcctgggttttatgaatgtattgaattttctaatttcaatgttaatggatacatatttctttctagatttcttttcttttaaataataagcaactggtttgacatgcctttaatcaagatttatcatgaccttattagaaagttaatgtttggaacatttactctctgatgaaccaccaattttgtattttacatttatctgcaatttccaacagtgaagaggttgtctgcaaatggaattaattcttctccatttggttatcatctcctttgctccaatccctggtaatagctaagcttgttcaagatattaaagaggtagatcaaggatctaaatggtagggaaaattttcaatttcttaaatttcatttattatgttgataaatctggcctctttgatagtttgtcattttcatagaattgattattcattagcaccattgcagaccatatagctaccatctttgcttaggttttctagcctctggatctgattgagaaaggaagacatttgaaagcatatctgagtacacatgactcaatcattgattatgtcaatttatatctacacatggaaatacatatatatgtgtatatatatgtgtgtgtgtgtgtctatattgcagttaatgtaatgcttcatggagtatatactttagtatgtcaaaatggttatatttcagaactcctttcccttagaaatatattgtttgaagtacattgttattgaactacagtatctattcagaaaagtacaagactcataagtgtaaagctagaataactttcttaaagtgaatgtacatatgtaaacagaacataaacaaagtcataaaacaaaattactagtgcctagaatcacccttatatttcctaccaggcactcacttcttacaattacaacttttgacaccatgtattatgactgaacttttgtgtacttccaaacttcacatgtggaaatcctaatacccaatgtgatggtattaggaggtagggccttagttttaggtaatgaatgtggatcccccacgaatgatgctgtgcctgaatgttggtgtcctcccccaatttgtatgttggaacataatatgcaatgtggtaataggtaagggaaagtaattaagggaaagtaattaagtcatggggactctacccccataaatgggattagtgctcttataaaaaagtttaaaggagcattctggtttcttccatgccttccagcatgtgaggacacagcattcatcccttctaccatgtgaggatatagcaagggtgtgccatctatgaggaatgggccttcgccagacacaaaacttgtcagtgccttcatcttggactttgcagactccaaaactgtgtgatataaacttctgttatttatacattattcattctaagatattttgttataacagctcaaacggactaagacaaatgaaaattgcccttataagaagataaaccacggcttcttttcttggtgtttggttttcaacatgtgaggacacagtaaaaagacatccttctgcatactaggaagaaggccataaccaaaatccagcaatactggcaatcttatctcagacttcccaacctccagaaccatgagaaatacatttttgttgtttaaactatccagtctatggtatttttgctatagcaggtcactgggaggattccccttcaatggaattgaatgcaattcagcttaatcagtgttcaagatatagcgctgtttctctgattaccaggattcaggggttcagacggaaattggagtggtggtaacattcattattacctctactgacctacaggcaaaaattttgtttcctgttcctgtgactttatgctctgctagcctaaaggtcttaattccagagggagggatgtttccagaaaaagacacaacaatgattgtatcaaactggaagttaagactgacacccagcaattttgggctcctcctgcctcagtcaataggctaagaagggaattactttgttggctgggacgaatgatcccaactaccaagaagaatatggactgtgactctacaatggtggggaggaaaaatatgtatagaataatagaaatcttgtacggattctcttattatgactgtgcactgtaattaagatcagtgaaaatcgaaaacagcccaatttaggcaggactatgattggcctaggcccttctggaattaaggtttggttaccctgccaggtaaaaaatgacaaccagctaagatgcttgctgaaggcaaatggaatacagaatgagttgtagaggaaggtagtttgaaataccagccttgatgatgtgaccggtttccaaaaggaggactgtcatcatcatgagtattcccttcttattttgttatgaatacagttgtgtttatacacaaatacgtgtgtgtgtgtgtgtgtatatatatatatatgtatatatgtaaagcaaatgcctttgatttattttctctgttattctataataatttaaaataaaacatattgactttatattagtatttaaatattgtcaatgttacatcatagtatttaagttacgggatgtcaggagaggagtaaacatcactcatttactttactttctcttgtgtggagatcaatggattttttgttgtatgcagaatagctgcatcatgtcaggaggaattatgaccattttcctgtcttaatttggagattaagtatggcttgaggagatgtgtacatgtgcccagttgacaaggggtcttcttgttatggttcatttaatgtgttgacctggactgtgctaagggatgctcagataactagtgaatcattattgtgggtgtttccatgaggatgtttctgaaataaattagtatatgtattggtgaactgagtaaatgtaaatgcccctgctcaatgtaaatgggcatcatctaatctgttgagggcctgaataaaataaaaaggcagagaaagggtgaattcactctctatgcttcagctgggacattcgtcttctgctgcctgtgaacataagtgctctggttcttaggcctttgcatttggaccgggacttacacagtggttcctctggtcactgggccttcatacttggactttgtcatttaacatcaactcccctgatgctcaggcctttggacttggactgaaactataccactctctttctggtcccccagcttgcagatagcagaacataggacttctcaacctctgtgattgtgtaagccaattccttataacaaatcttatatagctagacatagatagatgatagatagatagatagatagatagatagatagatagatagatagatacatagatgatagatagtaagtagatagtagatagatcgatcttctcttgcccctttttctctggagaatcctaagacaactggttgaacatcttttcatgtgcttgtttaccatctgtagatcatttttcagtgaaatgtctgttcataccttttgaccattttccagttaggttattattaattttttacagttgacttttaagactactctacatgttctggatataaatcctttgttagatacatggtatacaaatattttctccctgtctgtaccttggttttcttcctcttaaaagaatctttagactttgatgaaatctaatttataggtgtgaccattcgtgcagtaccccagtatgttgttatgctatgactaacctgcagtaaaatccatctacccaatttataatttcatttattttgttttttcaaaatttctagttaaaacaataaattctaatattctaatgaaatcattcacttttttctcttatctgccattatttgccttccaactataatatctggaatacctcagctctgttattattttatttgttaatcttccttttggttataggattctgtcttttggtaggaggaagtttttgacgaaggcaaggtattagttataaacgaagttacacactccatgtggtaatattttcctgcacacatagtttcgaatttcctctgctaagcagagagaatgaggactgttcactttaatcttaacagagagactgatttcaataggagcttcattgcactttttgtaaagcttggtagacttctgctttgacactgatcccagggtacatactttcaactacagtgtgactgagtctagaccttacaactgagagcctggtatcataactgagttcccttcactggctggtcctcagctttccttttcatctcctgagcaaaaataaattgcagaaaactttacaccactttacagagaatatcagcttagcttttcagcaccttgctacttgtagcttcagaatttggcaaactttttgaaaataaaacaatacacattcaatgcccagttttctgctatttaatatgttgaacattttgtgccataaagctttcaattttctctctagtttgttgacactgacaaacactttgcttatacctctgtctttcagcaaccattctgcctgagcaaagactggattttgagctctcagtccatttatgacaaaatggactcctgaggtaaaagtatctactcaactctcagtgtttcttctctctcccagaatcttgagcactctggtcttgtttctgtattagttccctaatgcttttaagaaaaagttatttatattttatgtaacttttctactgtctttttctctgtgaagcattggttggctttgagatactttatttttttgtctttttgaagtacttttaaaacactgaagcacgaaaacagaggcacaatcagttttgttcatagttgcatcttgcacaaggatactcgtattacataataaatttggaagataaatttgctgttttcaaataagtaacagactgcttttgtggaataaaaaagtggaaaatttgttttttttgtgtgtattcacagagtcgtttctatattttatctaaatttgtatattctaagtagaattgaatggacaaatcatttgttttgtccattattcatataatggacaaataattaatcattgtgtcaaatcatttgaagtcagtaacaaatttcctgattaaattttgtttgctgctctacacttgaatttttaataactttccagctattaaattgctatgttataacatcattttgaatattattgataaggatcttgttacaaactgcagaaatgttactaggtaaaatgagtgtttggcctagccaccacatatgcaatttagaacaatgtgatttccattcgttcatagaggtgcgatccccacctctagccaaagatccacagccacgcagggtgcatggtggctccccttctcaccccccttccctcctggatggggtgcttgggcggatccacggcacacacctgtgtctgcacatgtggggcgaggggtatgtttgcaatggccatgcagggtgggagagaactgtggctgctgcccaggccccagggcagtctcaggggccaggggcctcacgtggctagttggccagcatgtcccacccgccatcccctcctgccatgtgcccatagagtctttcctccccgggcgagaggtccggctttgtccgagccagaggaaggatacagtgatttaaggaatccatttgcatagaggaagaggttcttctccacctaaatcgattttttttctttttccttttctatgtgagaggtttcttttcctacctctgcactctgcttatgataggaaagcaacagaggagccatcccactggctaataacggcaaatttggcaaagtctgtctgggacttaatctaaataaatccatgcatcccccgagacacctttttgtcccaaactcaattacaaactttggttgaagccctagaaaggaaaaccagatctgagggatccaaagccaggcaacaggcacagagtaaatgggcaggactaattcctgttgattaagcccctgcttcatggaaggaggccatgttccatgtcatatatagataaggcctagggaactcaagagatttcatgactatgaattacagtaaaaaataagtactcttgcaaaacacagttggattgtttgtaacacaaagaataaatgcttgagaagatggaaaccctattctacatgacgtgattatttcacattgcatgcctgtcaaagcatcccatgtaccctataaatatatacacttactatgcacccacaaaaattaaaaataaaaagtaaaaatttagaaacaaacaaacatacaaaaaccaaaacacatcatacttcagttttgaaacattaaggtcccaattatgtttactcaaaaataggtttttaatttggtagtttttttatttttgagtgtgaatataaggccaagcttgcttctattcttataatttgagaatttaacaagcattgtttatttgtggacgtcaaactcttttttatttgacatatacaatataatatatataattataatattatatattataaaatctctactaaatagatatatttagtagagatggggtttcatcatgttggccaggctggtctcgaactcctgacctcaggtgatccgcccacctcagcctcccaaattgctaggattacaggcatgagctactgcgcccagcccctcactatctttatgagcagacacaacaaagatttattgagtaaatactatgttcagggcactattccatgtactaaaggatttttaaagataaataagacatggctcttatctctgaggtgttcacattctcatgtgaataggacaggcttatatacaatagtctaacacgaggcattatgtgaaaagtatatttcttcgcctcttctcactgcttagaaaagtgtctagaacatagcgtgcactcaattaatactttctattagcattaatattaatcttgtcatcattggaaaagatataataggaactgacactggagaaataagtcaggtccaaattatagaaagattactatggtagtcaaaatcccccacttctcatctccactgacactccaaccttgatctagatgtggttatacctccataatctctcactttgccgcacagtctccccattggtgtccttgactcttaatgtgcactcctccatgttcaaaaaacagaaccattcttaaaatataagtcaagtcatatgatacttgtgctcagaatcatcaatggattccaaattagataaaagtataagcaaaaaagccctattttgtcctaaaatgccctacagatctgtgttcccactatttctctgacttcgtcttttactcctctcttctttatttttctcaagttacaatgccccattggtattccacaaaaacggcaaacatacttctatctcaagtcctttgcccttgctattccatctctctggaaaaactctttacccaaatatcagcatgaccaactccttcatttagtccaagtctctgtgcaaatacctctgtatcagagagtctttaccttatcatcctatgtaaaacagcactccaaatgaccctctttaaattttcagtatgccactcatcaccacctcaaatattgtattcactgtgtgttttactttaactcttccccaaccctagattataaactctgtgactgaaaccgtaactattgtttgctactatattatcagcagtagaacagtgcttgactcatagtgaggtcttgatgaatttggttgaatgaatcacttaatcaattgtcccaactttataaactcaagtttaaggtatctgaaaattctagtctaatcccaaaccatattgatgtattggtccttatttaaacccttaaaaaataggcattaattgctttatcatgcagtctcttttaattagtgtaattttgactagattgatatgctggtttagtaattactttgtgattttatatgtatatgttacatgcttggattataatagaaatgctagattttaaagttactgaaacctataagaaagcagttttgtcttatttttttaaatataactcagccatcttttctgtacacacacatacacacacaacctcatagatgtggttttaccaatatcaatttaaagaagggcactatgatgtttgttttagatctgtacttcctaaattatctgtagtctaagaacagtttttctctccatctaccatggattcacacttttataaaataaaataattcattaatataaacttaatagagaaaagcaaagacatgagtcaagtctatgttttaaatgattagattcaagagacataaagttttctgtaaacatttcttttttaacattctgtttcaatttatgtacttatcacaaaccagaatcaaacaattcctggattagcactggtatccagacctaaatttgagtagcattgctttatatattaaatttcgaacacctctctacaaagtatttatattccagcttttttaaaagtaaaaactgactataagagaagttaacgtaatacagtaaagactatttaacaggaacatttgatgaagtagatcattcccgtcttctaaaaactttcactttctttgtttttcattacaccttgttcttctgatttgtgtttttcccctctgatttgtttcttttctgtttccttcacttcttcttacttatccaaagattacagtatctttgaaatatgttttgaactctcgtcttttctacatcaaaatacacttcctggctccaattgtgaactataaaacattgattaaaaatgtatatctaacttctgatctctctgcacattgtcacatttgactactgtattaatcatttttttaaatgttatgtattttatgatgtgttgacatcttacaaaggctactagccatgtaaagactgccagggccagggctagccaattctttgagttagtaaagggccaggttgggagcatgtcttgcatgtgcaatcgagccaatctttggtctatagaccaaagtctatagctccattcacagccttgtctaactctttacacaccaagccaagatttaccttgccctaaatcacctagggccaaatataaaaaaaaactggagaccgtctttatacctcaaggccctttcaaattattcaaaccagccaatattaagttgtttattctgtccggccttgcttttcccatagaaacccccataaagactctggctctggattccctttgcttctatctttttccatgtgagaaaagcctagccctctgtggtcctctgtgacatttggcgaccctactctgttggacctgtaaatataatcaaacctcttccttctaggccttgttcttgttttcctttgcagctacactgactgtaccacaccacatttttcgaacttttatgcgtgcccatatgcctcacaaacatatataattcaacatacccactattgaaatgaacattgtctcttcaaacgttttccttctgttaatatttcctacatcagcaaatggaaacatactctttcaataaacacaattgggaaactttaaagtcatccttgactagcctagtttatccatttatcttttattattcaatcaattggtaacaaagttctgcctccaaaatgtatctcaaatatcatttacttctctatcatttttacaaatatcagtatagtccaggacacaatcatctccatcatgaagtcctgactggcttcccagtttctgctcttactcatcattctgatctatcttccactaactgccacgtaatctactttttaaaatagggtaagattgtatcttgttttcctgagacaattgtaattttcatctattatctcatatagtgattaatggtaccccttcctttctattaagtgagacagtatgtacaatatattctatcttcacgctacctaatagtcattaaaataatttattgagccatgacaaagtaattggctccagaatagtttcattctcttaaaaaactagaaaagcatattaaataagttcgggctgtggaaagcagatagtaaaggatagcaatcactaagaaaagtgaaaacactgaagtaagtcctatgatcacccaggatttctccctgcgggtaactgtaggctatggtgcaaggacaggaaatccctacatatcgtagtagttctattaaattgaggatactgagttaagaaagccttaccaactggaatttgtcagatagagtaatagagaagggagggtgagagtaaaaaatagattcaggtccgggtgcggtggctcacgcctataatcccagcactttgggaggccaaagtgggcagattacccgagattgggaatttgagaccagcctgaccaacatggagaaaccctgtctctactaaaaatacaaaattagccgggcgtggtggtgcatgcctgtaatcccagctactcgggaggctgaggcaggagaatcgcttgaacccgggaggcggaggttgcggtgcgccgagatcacaccactgcactccagcctgggcagcaagagtgaaactctgtctcaaaaaaaaaaaaaaatagattcaaaaatgtacatatggattcccttgggtctttcactaaatgttaagctgaacatgcacagggtgaaattccataaggctagacagagagcaactgggagacaactgtatgctgaacaattcccagaattcacataggcctaagaggcattttcagtagctagagtggaaaaaacttgtttagcacctagggcattcagtgaagacaccagaatggctatttctaaaaagtagacctaaaatgtcctcagagtaaaggatacttctgactcatgttaacaacacttaaaaacaaaccttaaaagaattgagctgatgcgcgaaatcttatatcaactatttaaagaaataaagcaaaatccagacaaccaataatgttacattatcaagaaatcaattaataattagaagatgtgttaggaagcaggaaaatataacatataaccaaggggaaaatcacacaaaagaaatgaacacagaaataacaaacatgataaacagaaaaaaaaactttaaaatggctattacaaatgtgaagaaggccttaaaggaatatataaacatactgagaaaaaatagaaatatttttgttgtttttaattgtttttagacttttcttctatcctttttttttcaacttttattttgagttcaggggtatatgtgcaggatgtgcaggtttgttacataggtaaacatgtgccattgtggttttatgcacagatcatcccatcacctaggtattcggcccagcatccattagctattttgcctgatgctctcactcccccaacaccaagcctccaacaggccccagtgtgtgttgttccctgccatgtgtctatgtgttctcatcattcagctcccacttactaatattattattttttccgaggcagggtcttcctctgtcgcccaggctggagtgcattggtgcaatctcagctcactgcaacctctgcttcccgggttcaagtaattctcctgcctcagcctcatgagtagctgagattacaggcacgtgtcaccctgcccagctaatttttgtattcttagtagagacgaggtttcaccatgttggccaggctggtcttgaactcctgacctcatgatccaccctcttcagcttcccaaagtgctaggattacaggcatgagccaccgtgcctggccctcagctcccacttataagtgagaacatgtggtgtttggttttctgttcctgcattagtttgctgaggataataccttccaactccatccatgtccctacaaaggacataatctcattccctttttatggctgcatagtattccatagtgtatatgtaccatattttctttatcctgtctactactgatggtcattttgggtttattctatgtctttcttattgtgaatagtgctacaatgaacatatgtgtgcatgtatctttataatagaatgatttatattcccttgggtatatactgagtgatgaattgctgggtcaaattgtatttctgcctctagatctttgaggaattgaaacactgtattccacagtggttgaaataatttacattcccaccaacagtgtaaaggcatttcttattctcagcaaccttggcagcatctgttttttttgtttgtttgtttgttttgacattttgataacagctattctgcctggtgtgaaatggtatctgtattagtccattttcatactactatgaagaaataaatgagactggataatctataaagaaaaaaaggtttaatggacttacagttctgaatggcttgggaggcctcacaatcagggtggaaggaaaaggaggagcaaaggcttgtcttacacggtggcaggcaatgtgagagagcaagtgcagggaaactgcctttataaaaccatcagatctcatgaaacttattcgccaacatgaggacagcatggaaaaaaacccaccccatgattcaattgcttcccaccgggttccgcccacaacacgtggagattatgggagctataattcaagatgagatttgggtggggacacagccaaaccatattagtatctcattgtggttttgatttgcatatctctaatgatcaatgatgttgagctttttttcatgtttgttggccatatgaatgtcttcttttgagaagtgtctgttcatgtcctttgcctatggttttttttttcttgtaaatttatttaagtttcccctagaccctggatactagacctttgttagatggataccttgcaaaaaatttcccccattctctaggttgtctgttcactctgataatagtttattttcctgtgcagaagctctttaatttaattagataccacttgttaatttttgcttttgttccaattgcttttggcattttcatgatgaagtctttgcccatgcctatgtcctaaatggtattgcctagattttcttctagggtttttatagttttgggttttacatttaagcctttaatccatgttgagttaatttttgtatatagtgtaaggaaggggtccaatttcaattttctgcatatggtttgccagttctcccagcaccatttattaaataggaaatcctttccccattgtttgtttttgtcagatttgttgaagatcacttggccgtaggtgtgtggtcttatttcttagttttctattctgttccactggtctatgtgtctgttcttgtaccagtaccatgctgtttggtttactgcagtttaatttgaagtgtagtgtaatttgaagtcaggtaatatgatgcctccagctttgtttgtttttcttaggattgtcatggttattcagggtcttttttggttccataggcattttgaaatagttttttctagttctgtgaagaatgtcagtggtagtttaatgggaatagcattgactctataaattacttaaggcagtatggccatttttacgatattgattatttctatctatgggcatgaaatatttttccatttgtttgttttctctctgatttctttgagcagtggtttgtagttctctttgaagatgtccgttactttccttattttatcctcttcatagcaattgtgaatgagagttcattcatgatttggctctttgcttgcctgttgttggtgtatgggaatactagcaagttttgcacattgattttgtatctagagacattgctaaagttgcttgccagcttaaggagcttttgggctgagatgataaggttttctagatgtaggataatgctatctgcaaagataatttcgcttcctttctttttatttgaatactctttatttctttctcttgcctcattgccctggtcagaacttccaataccatgttgaataagaatggtaagagagggtgtgcttgttttgtgccactttgcaagggaaatgcctctagcttttgctcatttagtgtgatattggctgtgagtttgatatatgtgaatcttactattttgaggtatgttccttcaatacctagtttattgagagtttttaacatgaagggatgttgaattttatcaaaagccttttctgcattgattgaaataatcatgtgttttttgtcttttgttctgtttatgtgatgaatcacattcattgctttgcatatgttgaaccaacagtttataccctctcagatatgaagccaactggatcacgatggataagctttttgatgtgctcctggatttggtttgccagccttttattgaaaaatttttatatcaaggttcatcaaatatattggcttgaagtttttgttgttgttgttgttgttttgtatctctgccaggttttggtatcaggatgatgctggcctcataaatgagttagaggggagtccctcaattgtttgcaatagtctcagtagaaacggtaccagctcttctttttacctctggtagaattcatcctttagtccttctggtgctgggctgtttttgccttggtaggctatttattagtggctttattttagaacaatttctcagtctattcagtgactcaatttcttcctggctccttggtagattgtatgtgtgcaggaatttatccatttcttttagattttctagtttattttcatagaggtgtttgcagtattctctaatagctgtgagtagttcattggggtcagtgatatcccctttatcatttctgattgtgtatatttgattctgttttcttttcttctgtattaatctagctagcagtctattttattttattttatttctcttaaaaaaacagcttctggatttgtggggttttttttttttttgaagaattttttatgtccccatctccttcagttcagctctgatcttggttatttgttgtcatctgctagttttggggtttgtttgctcttgattctctagtttttgttaaaaaaatttgtgatgttaggttgttaacttgagttctttttaactttttgctgtgggcatttagcaccatgaatttccctctgaacactgctttagctccatcccagaaattctagtacattgtctctttatcctcattagtttcaaataacctgttgatttttatcttaattttattatttacccaagagtcattaaggagcggatcgctcaatttccatgtagttgtgtggttttgagttcatttcttaattttaagttcaaatttgattgcactgtggtccaagtcttttgcatttactgaggagtgttttacatctgattatgtcatcaattttagagtaagtgctgtggggcaatgagaagtatgtatattatattttgttgtttttgggtagagacttctttaggtatctaccaggtctgcttgatccagagttgagtcctgaatatcttcgttaattctctgtctcaatgaactgtctaatattgttggtggggtgttaaagtctctcactattattctgtgggagtctaagtctctttgtaggtatctaagaacttgttttataaatctgggtgctcctatattaggtgcatatataattaggttagttagcttttcttgtattgaacattttacctttatataatacccttcattgtcttttttttatctttcttgatttaacatctgttttgtcagaaactagaattgcaacccctgcttttttctgctgtccattttcttggtagatttttctccatctctttattttgatcctatctgtgtcactgcatgtgagatgggtctcttgaggacagcataccaatgggtcttgactctttatctagcttgccattctgtgtcttttaattggggcatttagcccatttacctttaaggttagcattgttatgtgtgaatttgattttgtcatcacgatactagctggttattttgcagacttgtttatgtagttgcttcattgtgccattggtctttgtacttcagtgtgtttttgtagtgtttggtaatggtttcctttttcatatttagtgcttcctttagaagctcttgcaaggcaggccttgtggtaatgaatttccacagcatttgcttgtctgaaaaggagcttatttctccttcacttatggagcttagttttgccaggtacaaaattctgggttgaaaattcttttctttaagaatattgacagccaggcgcagtggctcacacctgtaatcccagcactttgggaggccgaggagggcagatcacgaagtcaggagatcaagaccatcctggctaacacggtgaaaccctgtctctactaaaaacatgcaaaaaattatctgggcgtggtggcgggcacctgtagtcccagctactcgggagtctgaggcaggagaatggcacgaacccaggaggcagagcttgcagtgaactgaggtcatgccactgcacttcagcctgggcaacagagtgagactccgtctcaaaaaaaaaaaaaaaaaaaaaaaaaaaaaaagaatattgactattggctcctaatctcatttggcttttagagtttctgctgagaggtccactgttagtctgataggcttcccctttgtaggtgacctggactttctctccaactgcccttagcattttttctttcatttcaaccttggagaatctgttgattgtgtcttgtggttgatcttctcatggagtatcttactggggttctctgcatttcctgaatttgaatattggcctgtcttgctaggttggggaagttctcctggattatatcctgaagtgtgttttccaacttggttctattctccctatctctttcaggtaactcagtcagtcatagatttggtctctttacataaccccatatttcatgcgacttttttcattgctttttattcttttttctctattcttgtctgcctctgttatttcagcaagatcatcttccagctttgagattctttcctttgcttggcctattctgctcctgatacttgtgattgcattgtgaaggatctcgtattgtgtttctcagctccatcaggttggttatgttcctctctaaatagactattgttgctatcagctcctgtattgttttattatgatttttagcttctttgcattgggttacaaataattgtgtattttatgtgtcacaaagtaatattttgatacacatacacattataatgatgaaataagtgtaattagtatatccatcacctgaaatacttatctgtgacaggaacatttaaaattctctcttttaggtattttgagatatacaatacattattattaactatagtcaccttgctgtgcagttgaacatcagaacttttatctcttatctaaatataactatacccatcgaccagcatctctaatttctccatccaaacgcttacccccacagcctctggtaaccaccattctactctctacttctatgaatttgacttttttagatttcatatataagagatattatacagtatttgtctctttgtggccggcttatttcacttaacataggttcattcatgttgcaaattagagaattttctatttgttttcatcttaatgactgaatcgtattcattttacaattatatgtagtactttaccttttaaaatgcccatagttggacatttaggttattttcatatcttggttattgagaatagtgctacaataaacatgggtgtgcagaaatacctttgccataccgattttatttcctttgggtatatacatagtagtggaattttataattatatcatcattctattttcgttctttttaaatttttaatatttaatccttgtgggtacatagtaggtacatatatttatagggtacataagatactttgatataggcatgcaatgtgtaacaatcacatcctggtaaatggagtatgcatcacctcaagcatttatcctttgtgttaaaaacactccagttatactcttttgattttaaaatgtataattaaattattattaaccacagtcatgccgttttcctgtcaaatactaggtctttattcattctttctatttttttttcttttttttttttaactcattaaccatcctcacatccccccacccctgacacacactgagtacccttcccagcctctggtaaatgtcctcctactctctatctccattagttcaactgttttagtttctagctgccacatataagtgagaacatgtgaagtttgtgttttcattcctggcttattttacttatcataacctccagttccatccatgttgtagcaaatgacaggatctcattctttttatggctgaatagtactccattgtgtatatgtaccacattttctttatccattcatttgttgatgaaaattaagattgcttcccaatcttggatattgtgaacagtgctgcaacaaacatgggagtgcagatatctctttgatataatgatttactttcttttgcatgcatacccagcatttgaattactggactatacaatagctctaattttagatttttaagaaacttacatactgttttccaaaatggctatgctaatgtacaataccaccaagagtgtataagggctctcttctgtatatccttgccaatgtttgttatttttcactttttgaaaatagccagtctaacagatgggaggtaaaactcattatggttgtaatttgcatttctctgatgattaaagacattgaactttttttcatatatctgttggacattcatatgtcttcttttgagaaaagtctattcaagttctttaccaatttataagagttgtatttgttttattgttactaagtagtttgagttaattgtacattttggatattagccacttactggatatataatttgcatatatttttcccatcccatgtgtaatctcttcactctattaattgtttcatttgctgtgcaaatgatttttaggttgattcagtgtcttttgtctatttttgtttttgttgctcaaacttttataatcatatctaagtattctgcccagtgcaatattgtgttaggccattattgcattgctctaaagaaatatctgagacctggaaattcataaagaaaaaaggtttaattgactgacagttgtgtagcttttataggaagaatggtactggcatctgcttggctcctggtgaagcctcaggaagcttttagtcatggtggaaggcaacgttggagtagtcatctcatatggtgaaaatgtgaacaagagagagagtgggggaggtgccatacataaacaatcagatcactacagcaaagacagtaccaagccatgtgagatctgcttcgatgacataaacatctcccaccaggccccacctctaacactgggattatgtccttctgaaatttcaaaatataatcatgccttttcaataggacccaaattgtcaacacatttttgaattaactcaaaagtccaaagtctaaagtttcatttgagacaaggcaggttccttccacttatgagtctgtgaaatcaaaagcaagttatgtacttccaagttacgatggggtacaatggggtatagctattgaataaacatttccattggaaattgaagaaatcagccaaagggaaggccctgtgcaagttcaaaatcaaacagggccgtaattaaatcttaaagtttcaaaataatctccgttgaatacatgtcatgcatctggggcacactagtgcaaggggtgggcacactagtgcaaggggtgggcacactagtgcaaggggtgggctcacaaggccctaggcatttccacttatgtggctttccaggtttcagtccccatgcctgctctcacaggttgttgagtggctgcaacttttccaggtacaaggtgtaagctgcaggtggatctaccactctgggggcctggaggatggtggctcctttcccacagctctactaagcagtacctcagtgggtacactgtgtggtgccttcaaccccacaatttacctccacactgctctgtcagatgttctctgtgagggctctactcctgcagcgcactttttcctggggacccaggctttctcaaacatcctctgaaatctaggcagttgctgccaagttttctttactcttttactctgtgcacctgcaagattaacatcacatggaaactgtcaatgcttatggcttaaaatgtctgaagcagtggctcgaccttatcagcctggactttaccgtccatatcactatcaatattttggtcacaaacatttaaccagtctctaagaagtttcacgttttccttcaacttcctgtcttcttctgagtcctccaaagtcttccaacctttgcccattatccagttccaaggtcgcgtccacattttcaggtatctttatgaaaataacccattcctggcaccaactttctgtgttaagctgttcttgtattgctataaggaaatacctgacactgggcagtttatacaaaactaggttttattgcctcatgtttctgcatgctatacaagaagcctggtaccagcatatgctcaacttctcatgaggcctcaggaagctttcattcatggcagaaggcaaagggagagcaggcatttcacgtggcaagaacaaaagcaagaaagatagttgggggagaaagaagagatgtcatgcatttaaacaaccagatgaccattacaaagacagcaccaagccatgagggatctatctccatgacataaaccactcccactaggccctaccttcaacactgaggattacatcacaacatgagatttggagaggacatcgaaactatgttaaatgtcacacagtttttttttttctgttttactctagtaattttattattttaaatcttatctttaagttgttgttctatttttagttgattcttatataagggtgaaatcagggttcttttttttcttctgtgtatgaatatccggttttcccaacagcatttattgtagagattatcctttctccaatgtggattcttagcacctttgttgaaaatcaactcacactagttacgcagggttatttttggactctcttctactacattaatcaacgtgtctatttttaggccagtatcattctgttttgattcctatagctttgtaatatattttgaaatcccattgtatgattccattagctttgtcctttttggtcaagattgctttgagtattaggtgttctgtagtttcatatgaattttaggattttttctagttctgtgaaaattcccattggaattttgatacggattccattgaatttatagatcaatttgggtaatataaacattttaacaatattaattctactaattcatgaacatgggatatctttttcatttacttgcaccttcttccatttctttcatcaatgttttatagttttcagcttacagtttttcactttcttggtaacatttaattataaatatttttattgtattataaataacactgttttttaaatttttttctggtgagttaattgttagtgtgtagcaacactactgatttttgtaagttggtattttattttgtagcttaactgaacttttaaatatgttgtaacaggttcttagtggagtctttaggattttctatatgtacatacattgacaaatccgaaagactctaattctgtaatggtggtggataaattaattatgtgtctattataaagtgtaaaaacaaaactattaaaaacaaagcaacaataatttgttaagaggcacatattataaaaagatgtaaagtataacaccaaaacagtaaaaaatggaaagagagtaaaattacagaatttttctctgcaatcaaaattcaattattctaaacttgaaatagcttgttacaagtataaaatgtttcttgtaaacctcagggtaaccacaaaacaatattttataacaaaacacaaaagaataaaaaagatatccaaacaatgcagtacagaaggccatcaaacatcaaagcaaaaaagctagacagaaataaaaaaaaaggccctaataaaacaccagaaaacagttaacaaagtggcagtagtaaatccttacctataaacaattacaaaaaaaaagtatatgaattaagtgtttcagttaaagggcttagtgtagctgaaggaatgaaaaaaacaaagcccagttatatgctgcctacaatagactcatctcaacctaaaggccactcatattaaaagtgaattgatggagaaacacgttaaagggagacagaaactgaaagagatcagggtagctatatttcatttataaaaaataaactttaggtcaaaaactgtaaaaagggacaaaacagttaatgacaaagtggtaagttcataaggaggaactaacaattatatttgctccaaaattggagtacttaaatacaaaacaataataataaatcgaaaggagacatggaatgtgacacaatagtaatagggtatttcaacactccactttcagcaacagacagatcattcagacagaaaatcaataagaaaacatcagacttaaactacacgtaagaacaaatggacctaacggatatatacagaacattccacccaatagcaacaggatatacgtttttctcaagtgcacaaggaacgttctccaggatggattatattttaggcaacaacacgattcttaacacattgaaataaaaagaaatcatatcaagtatcattttccatcgtaatggtgtgaaactggaaatcaataacaggaagagtcatggaaaattcacaaataagtgaaacataactaatacactcctcaacaactatttagtcaaagaataaactaaacaggaaatttaaataatatcttgagaaaacaagaatgaaaacagaacataccaaggcttatgggatgcagcaaaagtagttctaagaagggagtgtataacaattaaaatctacatcaaaaaagaagacagctctcagataaagagcttaacattacatcttaagcaattagtaaaagaagaacagactagtcccaaagatagcagaagaaagaaaataacaaaggtcagagcaaaaataagtgcaataaatacatgaaaaaaatagaaataaagagaataagagttggctttttgaaaaggtgaataaaattgacaaaaccttagctaaactaactaagaataaaagagagaagacaaataaataacatcataaatgaagaatgagacattacaattgataatacagaaatacaaaggatcataagagactattgtgaaaaattatatgccaacaagttaaaacacctggaagaaatgaatcaattcctagaggcatataacttactaagacttaatcatgataagatgggaaatcttaacagaccaataacaagtaaagagattaaataaaaattaaaaagtctgttcaaggaaaagcccagatccagatagcttcatggatgaattctaattaacatttaaagaactaatgccaatcattctgaaactcttccaaaaaattgaagagaaaaagagtacttccaaactaactttacaaggccagcctcaccatgataccaaagctagtacagtacactacaagaaaagaaaaactgcaggctaatataactgataaacatagatgcaaaaatcttcaacaatatgcatatggactccaacttagggtggttcaatttaagattttttaactttatcatggggttatgaggataatatcttcaacaatacattaaaagtgtcatcatttaccatgatcaagtgggatttatccctgggatgcaagattggttgaacatacataaatcaataaatgtgatatgtcacatcaacagaatgaagaacaaaatcaacaccatcatctcaatagatacaaatgaagcatttgacaaaacttaacatcattttatgataaagtctattaacaaattaggtaaagaaggactattcctcaacataataaagactatatatgacaagcccacagctaacatcgtactcaggaattaaaattgaaggcttttcctttaaaatcagaaaaaaataagtatgcccattctcactacttctgttaaatatagtactggaagtcctagccagagcaattaggcaagagagagaaataaaggacatccaaataaaagaggatgaagtaaaattatctctgtttctttgcaaccacactgttttaattgccagcaatgacatgattttaaatgtcagtaaaaggcaaatatgaatttttcttcaagtacaacaaaatcaaggaaactatgtagttactcatcatgtttttcaaaggcttaatagaaattcatgagacaaaattaataaaataaaaatataactcaaggcctcaaaaatttataatgattaagcaatagaattatctacagtcaatctaatgtatttacctctacttatctccccatggtccaaagaaccatcgtctcagacctaaattatttcaaaaaaacttctaaatgctacccctgcttcttcccttgctactcatcacagatgattttttacaccacaggacaaacagtcttgctaaaacgtaggtcacagaatcgttctttgttaaaaattttcagtgtttttctatttcacttttaaagaaacaaatacattatagataaattctaactaatatttaaagaaccaccacaccaaaaatctcacagtttttaacatctctgaattcattaattatttatttgaccatgctggcctctcttgaaaaaataaaataaaataatattctaggcacgtttctacctcatagcccttgcacttgctcctcctgctgcctggaacagtcttctcccagatatcctcatgactttcctccttaccagattctcgtctttacttaaatgcccccttttcattgcagtcttccttgtccatgctacaaaataatcctgcccctttatcttccttttctactttactatttgatagcttttattccatcaactacactacctattgcatttattaactttctgtctacactaatactacaatgtaatctgcacgagtatgttctgtgcacttacgttaagtgaccaaatggcttaaatttagtagacacttaaatttcagttgaatgaataaatttctttggtcctctctagtgttgatattctgacagctaatcatattatacataattgttttgttgatggaaccaccctgttacacgtgattttaagtctattcacaagtccagtcctggcaaatgtttaacaacaagatttctgatgaaaaatgcccttatttgtagaattttattaattccatggtgaacattctctcaccacaaacacgggattgagataaaatgcacacaactgctttttatgagctgatgttggcacaaattatagcacaaattgcattaactcatttaatgtgctcaatcaccatgggagacaggagttattactttggccatttttcaaatgagaaactacaacacagagaggttaagcatgtacccaaggtcacatagttagaaaggaatctacctgggatatgcctgatgattgacccgagagcttgtgcttagaaaaattcagctatacttcaggcctttgataaattactttaaataaaattcaggttttaaaatgaaaaaaaaaaattatagccatgcatattctttaagtgtcagtcaaggacctataaatattttttaaattttttgaatatttaaaaaaatgttagttttccaagcaaaaggccaagactgtgtgctttgcttaggccattttattttcagacactgaaaatatctgtaaaaatgataatacctcactctggtttgccagagccaattagatttgtcagtatcagtctatatcttattgatcgaaaccgcaggtagtaaaaaacattcgtgtgttttctaagtgttctttcttgttttggattccttgcttaaatcagaatcttactgaactagaaataagaaagtttagactccctccttgtttttaggaatataatgtacctagctgagtggatttctatttttcaaaggcacaataatccagttaaaatgcagtgattctcttaggtactacatagattttacattgtataatcattgcaatcagccaccaaatccataactctcattagaaagcagtgtttcttttaataccattaatttagcctgttttgaagtccttattaagaattcacctagctaaaccatgacacttatatggattcgacaaacttgctctattgcctctagttctgaaaatagattttaattatcatataagattaattaaaagaaaaatgtaattcagtattacctttattttttacatcatgaagcactgagtaacaacatctatatactacgcatattgtgtataaaatcaatgaatgtataatagctgtatggaaaacaggtttaaatctaaaccaatgaaccacagcactaaaaaattaagcaaatgtttattacatcattttggatattgacctttggatatagaaagaaaacattttgaagaagaatctgagtctccacattttatttttagaggagtaggtacttctggacaccatctggtcagcccatggcattcaaaataaaacagtgtttggaatattgaaattaattattaaaatgacaaggagaattttaaatttctaacttgcagacatgggataattttgactatttctggtataaaatgacaggaggcatatctttctggcagagttttgatcttgtgaaacagctgcaacagaaacacatgaatgtttttctaaaaactagatttcaatctccacttcaacttactggatcaacatacataggtaaggctcttcaaacctagaatgcaaggatttaacgatgctgctattaaaaataaagtaactaatttctttcacataaatcattatttgttaattttcaaatggattatacacccacattttatttctttttggaatcaaaaatggatttagggccaagattttagtagaaaagaggtttctttgtagaaaaaaatattgcagaaaaaatactagtaaaaacattggacacaaaaatattagtaaaaacattggatgtgatagaaacagaagtgttaaaagaaatgaagaacaaatcggggcatggaaaatgtatttcttcttaaaaatatttgtaaaagcatgagatgcagctatctttacaattaaattaaatgtgtataaatggagaagactgaactataatccaaatactcagtaattctagtgaaatttgacatatgatagatcaatatttgtgaaaagaatagtttaatcaaaatactaggtcaagtctcttcgcaatttttctttatatagttgaaattaagagggacagcctggagaatattctaagtgtggcggggcctataatcacaataaaatattgatctgctttctcagatgatggcattttggatacacaccactctaagaaattaatcgtacaaaagcaataaatgttcatttgtgagatagtatgtaaaattctgatagaatttggtcacttattgttcatttttaaagtcaaggaataaagaaacagtctatgaagagtttcagataaaaaaccaaatgataggctaaacgtaaagctgagcattagtgttacttgacattctcaggcaacctgcaatgtgttatgaggcccttacttaattttcagttgagataagaaagttaaataaattatcattcatagaagtcattaaaacaaactacacccatgcattttccagccagaattcactgtaaaattttcattatgtgaaaaaaacctgatgaataagaataatgactttttccataagttggcacacttcccaggctagaacacaggagaacctatctaccaaaaactatgtccttctactcccttcaatgaataaactactgttttttttaaaaaaagtttatttctctcacacattaacaaagattagaagtaaacagttcaagatttgcatggcaactctgtgattatcagattatccttctactgtcaaaatgtcatttccaccttctggaccaagatggctgcctgaggtctagtcatcagagctgcagtatgatgaacaggaaaaaataaaggatgaaaaagggagcatcctcgtcctttaatgactctttcacaacgttgcaaacatcaaagagtgaactgatcttaatccttcaaaataaacaagagtcaggaggatttcaatttgaatcccaagtgtattttgggaatattttataagactaaaacaaagtgttttatgttccatgcctcagtttctctagctacaatgaaaatataaaattctgtattattcatcttccttactcaggggctagaggtgataacaagaagagattgatatgcagttcaaatatagacatgtgatagtgatacttcataacataaaaacaatattttatgactaatgggcagaataaatccttcgtctttctggcacaatatgcataacttaaaagaatgtcagagaaaaaaaaacaacattagaatggaagttgttaagaactatttaaatgactttataaccgtgtataaacttacctagaatagggatgcattgaattgttttaaataaaaaattttcttaggtcagaagggaaatcatttttgtgactgtgtgaaaaatacattctcacattggataccattccacaattaatctactgccctttttccttatgcccattatattacgtatgtattcttggcattcaaagactgcacatggtattactctgttttgcctatacttttaacaatatatttcaggacctttttactgtgattcttcaggatatttcaaaaagtattatgaaagatggtagacctagctgctggataactgtatttactgacaataaaaattggtccacttaaattttaaggagataagacaatctcaagtgaaatgaaaatcaataactggtccgtttttatctgacatactagctaagccacatattagagattaaagttagaaattaaaatgaacacaatatggtaatttcttttttggtgttagatgttctttcctccatagaagagatgtgttctagacatttttttgtgtgaaatgaatttatgttaagtgaatcttcctttctgatagaaaattaaaaatttattctgttgattataaaacaagttcttacggacttgacctttgacaaatctcctattggtgcttggtaccagcatgagctaactttatggcccaaagcaacaggacagtgtgctgaggtctgggagcaccctctccagagaatccctaatgtccaaaaattggtcaaaatctaaaatttattttgctgtacaattcacctttttttctggagttgtatttgccttcaacgagtaaggcaagatttcctgcttctgtgatgatggaaggccaataactcctttatgaagtttgattttgctcctgcagggaagatgagtttgagttttttcctgtttctaggatgatagagagcagtcttcagcctgagacccatccctaggtaaatagctgagttagggttttgtcttggctaaggtgtaacaaccagctggtcttaatttctctctaccattagaacattctgcgatcatattgttggggtattttgttgttgttgttgtgtgttctggtctttcttccatcagatttgaccaactctacctgacatggtcaaattcaagtgagaattccaaattataggtaataaagctgctctaatctggtcaaacttcttcgcagcttcaaaagaagaaaaacaaacaaacaaacaaacaaacaagaaacaaacaaaagtgctcggtttctgtgtttgcttcctgtctttaaaataaaatgttattttgtgtacttttcttccaccctatatctccttctccctttgccatctgcagtaccaaaaaaatctgaagaaggcttctagtgacttgaatccctttaaagaattcaaaacaaaggcaccacccactccttttggggtgttctgttttctttgtggagtttcaagagtcataggcagattcttcttaggtctattgctctgttttcttatgtgaaaggaaaatatcttgggcccccaatgttactaagctaaagaaaaaaataaaattcaagcttggaatttcttagggcaaacctgccttacgttctattcaaagtcatttctctgttcactgagataaatgcaaatctgataacttcctttaaaaaggttaatcagaaactcaaaagactgcaactgtttgtctcccacctacctgtgacctggaagccccctccccactttgacttgtcctgcttttgcttccagttgtcctgcctttccgaaccaaacaaatgtttattttacatacgttgattgatatctcatgtctccctaaaatatataaaagcaaggtatgctctgaccaccttggacacatgtcgtcaggacctcctgaggcaatgtcacaggtggaccttctcaaccttggcaaaataaactttctaaattaactgagatctttttttatcccatatatgagcaagtattgtacctagagtggacaagtccctcctcttactttcaggaacaccctactctgtctatagagtagctgttctttcaccactttactttcttaataaacttgcttttgctttgcactgtggactcggcctgaattcttttttgtgcaagattcaagtaccctctcttgggtctggatcaggacccctttctggtaacactgttaaaacacagaaaagtattgatgttgcaccgttcacattacctgaacgtattggtctgttttaaggcatttcttgagattatgcatgaatttttacaattggcttggaagggaggcaattgaagtatgaaagtgaagtgtaagaaaatatatcctggactggtagtgccctggcaactgtctgcttgtgttgagtcctcttctcccaatgtaaagacttgttatttgacattcagaggtatcatcattaggacacattagcaaaatagtgtttttgatattgacaaaagattatcatgatgctaagactagcaaaatattgagaattagctagcttcaacaagcctgaagtgaagttatatatgcatatattagttagcgttgctttcaggaaaatgagtatcaagttagatattagccagttatgaatgtctcattttaactaatgcaagtgatgttactgagttttcaactgaacacatgcagttgatgtatttattaatatttgaaggtagaatttgagactatttgatttcctgaagtttgaaatacgttttcataaatccttattgacaaacatgtatatgtctaaaatatgttttaattagcttaatatttattaatgtaacttttgactatactataaaaagtcaaagggcactaaagcgcttatggagaatagcagtcccatgtgccactcctccagagcaagcacttttaagttttatctcttaattcatgtgtttgcttccacatttttggataatagctttgattgctatgtttgtattttttctttccatataatatgtattgacttccttttttggtagatgagaatttagttatctcactctactttatctctctttcaacattatcaatagaattacatttcaatttttcttaaattaatattcagtggttcatttgtcaggagtatgtaaatactgcccacaattgggccacatagggtgctgtagttacatttgcttttttgtacaactctttgtcatatcccagtgttaactttccatctttttattggcctaattcaatttaatttaaacattattaaatatgttagatctgtaaaagaccttttaatattattttttcaggcattcaaacaaatgaactcattgattcatttcttttctttctttttctctcaagggtttcttttgacattctctggtcttcttgatctcagctggatctggagctctctaagatgaaattgtagctgacaatgactttcctcataaatctataatagcttaatataagctattatgtaagcctaataaagcttataaggggctttctatattaagcagctattctttgtattgcttacccttctcttttcctaatttactacccgattttatgaagcccatatgtggttggcaaaattatttgaaggcctcaaagattcctgactccttattccagttacttatcttgtcccagttattcaatcaaattcaaatctaggtactgctgtgtaaggatatggcagatatatttaagtgtttaaatcagttgatcttaagatagggagattatctgggtgtgtcagggctaattacaagagccctttaaaatcagagccttttctccagctggtcatagaaaagaaagtgagagttatgaagcacaggaagacctcaagtcagtgttactggtttgaagatggagaaggtcgcatgctaaggtatatgggaatgtgggcagcctctaggacatgaaaacagggacattacatctactaccatgaaaatttgatttttgccaacaacctcaataaactggaaagcagattccccctcagagctttcagataagaccagtctttctggcgatattgatttcagtttcataggaccttaatcagagaattcagctaactccagccaaccccagctcagacttctcacctacagaaatttgagataataaatgaatgttcttttaagctgctaaatttgtggtagtttattatgcaacaatatgaaactaacatgacatcattcatcagtttcttgagataatttataatttcttaaatgcttaaacctatatttgatactgtgtttaatatcttagtttttacttgtcaacatattccatatttgaatatcaagatacatctaatggtcacatactaaaatagatttcttaggtgtgtttgaggtgagtacctttttaatcacctaagatatggtgatggagtctgtatagtgttgattcaattaaagtttacatgccatcaaatgtacccaaacttaaacctaggaaaagtggtagcagcatcttgaagatactgtgttatcttttttgtataagtttatctatcatttataaatacctattgtgttctaaacatcatgatataacctgcgaggaaacagcaattagcaagattaagtgtggactctagtgaccagaatatgctttgctttgatgttttaataattatgcaagcttttttcaagaataaggaatgcgtcgtatactcatacctcctttcaaaaagttgagcagtgaaaaaaattaatcaaagaatgtattgttttgactctataatggtaaacaatcaatttatttttttcttactaaatgactttgttggtgaaacgtagcagttgtcatattacgacttctcttgcttcagaaattaatgaaaaacacactagtctcctgaacaagtcatctcagataactttaacaaatctattgaaaataacatcttggtttttattgatattcgaaatagcactggataaataaatgcataaaccttctcagtttcccgttactctaaatggaaaagttgtaaaaccattcctttatattcgccacaatggcagatctgttccatgaatggtaatgcatgttttaaggtattaacaaaattgattatgtaaccctagatatataatggaacagaaggctaatgcttatgccgattctgccttaagtaaaatccatctgtttactactaaggtagcatgcaactcagctttgtttgaatagaacaagatgaatacttgaggctattttctatctgctaagacaaaagtgtagggaaacacatagtaaaacttatattttttaaagacacggttcccagcaaactctaagtatttactgtctctcgaatatgatcaacccagaaaagccacatgataggatacttgcaaatcttcccataaaccccagtcaacaatcatgtgcatacaagtcctggagacactcacagagaagcaactgattattgaattttatgtggaaggaattgagatgaacagttaaagggaaatttatattagattttttcttataggtctgcagatgttttctttttggaccattataaaagcatgaagcatagctttgaaaatgttattttaaaaaatatgtttctgacataatcatttatttctgaagaaaatgctttgttcatattatagttgatattttcaatgagatgttttgattagccttatcaactcttcagtatttgccaaataccctccacccacagtcatgtttcttttgtgtatatagttctattaaagtctggtaatttttgagatcaagatcaaacaatatttcatttgtgaaaccttctataactgctgtgctttcctctgcacttgactatgtttgcttaaacttctaatagagtgattatttcctttttccttgctatgtttttaatgatgtatatttccctcaagtcggtcaaattgcaagctccttgaaaacaatgatatgcatcagaaccagaaccttcatacaagactcacatagtggtgacttcataaatgccctgttgaattgaatcttaaaaagtaatccatgtcatccatcagcaaggaaagaacaattagtatatcttgattgcggatcatttgtttccttaaaattacccagggagaaaaaattggatgaggccaagagtattcctcatagtctgctaaatatagccacaacctagggtttcataggaatagcaagaaaagctcttggacacttgaaagagaaagagaagatacagcaatgcaggactgaggctgataataatcagcaaatttacaaaagacagaaatatttaaaacccgtagattttatctctttgaattactgttttatatttatgtcttatgtattacctaccagaatgttgttcatattcacattatataaatgtgaaaatactttgtgaaattctaaggttacattgaaatgacttctatcattattatattacctaaccaaatattggctttgtaagcatctctttctgacatctcaacaatcaatccccaaacaaccaatttcttttctagtatcctgctctttaaaagcaccaaagtataggtctatactgtttcacaggcagaaggtcccaaagaagttattaaacatcccctcacaggaaagaccctgaagaaatatccctttgaagtcatggcaaacataataattggcttggtaattaaggttttgtattcatgtaacaaagttttcagtaaagcatttattagcatttatcagtacttaaagaggagtactctcagtttcaagaagacctcactattgtcataagatagaattgaaccaatatataatttgcaccgcagtatgtaacaagtctcttttagaaacaagacaacctgcatctcttattttttatatttccgttaaaataatagatgagtcgaaagccacttaagaatttacaagagttatatttacaaacaaattcatacagataacactgttgttttgtgcatttacaaaacacaacacatttatttagtcttccgcatgaaaagccagttaaagtagcttgttaccaaaaatgtgtttcaggagttgcctggctcccttataacttacaaaacttaaccatttgttacctaaactaaaaaagtagatcaataattgttttatttggaggaaagagtagcttccacgttaagaaacgatatctaagagaatatgatcttcacatcagtgctaagctctgtttctgcatctgtgagttaaagtctgttaaaattgcttcattataaatgacattcaatgactgaaggtctacacaagaggagaaaacggagttctaaaaagccactggtacatgctgaagagttcagacaactaagcaatcattttgccaaacaactgttttacctatgccaaatttctatcaggttctcgaggcacaatgaatgcctttttatttttaaaacaatttttattttatttttttaggttccgaggtacatgtgcagaatgtgcaggtttgttacataggtaaacatgtttcatggtcatttgctgcacctatcaacccatcacataggtattaagcccagtatacattagctgttttccctaaaactctctcccccaacagtctcccccaactggcccccgtgtgtggtgtgcccctccctgtgcccatgtgttctcattgctcagctctcacttataagtgagaacatgcagtgtttgcttttctgttcctgtgttagtttgctgagaataatggttttcttgaatttaatacaaaataacttatctcaagagaaaatacggataacctcttttgcccaacactgagaattatgcaacaaagacaaggttgcattctagatgttgcaggaaagtttcaactttgtgatttatgtaattttcagataatacatttcaatttgtgttcagtatatagaactgatgtacctcaacatttctcctatgtttttcttttaactgataagaatgcagaatactcaattcagagcccaattattgtatgtaattatctgctatgattaacaatatcaaagtcattgttttcattttattgattttgttgtaattttatttttgattattctcttttgcattatgtgtaaatttaaaagccacaaatcattttttgaaagaatataggacatcgtaataacttccagaattccttggaaatttcctgaactcttttgtttcttagcctatttaataaaggctgtgtactttcatagaattcacattttgtattttaattttaatcctagaatttggtttctcagacttcaattaatgattcctggagggcagtaagaaaggcagcctgcaatttcacaaaatcattgttctatttgatgatttgttataatcaaataagcatttttttaaaatttatttatgtctttgagatgggggaaaacttataagtagataggcagtgatggaacttaaacattactgtatacatttgaacaaatatatttaattgctagttaatattgttaggttctgtgttcctacccaaacctcacattgaattttaatccccataatccccacatgtcgtgggagggaactggtgggaggtaattgaataatgggggcagtttctcccatgctgttcttgcgacagtgagttctcaccaaatcttatggctttataagtgtgtggcatttgccctgctggcactcactttttgtcctgcagcactgcaaagaggtgacttccgccatgattggaagtttcccaaggcctccccagtcatgcaaaactgtgagtcaattaaacctttttttctgtataaattacccagtctcgggtatttctttatagtagcctgagaatggactaatacagtaaattggtaccgaggtagtggggtgctgtggtaaggatacctgaaaaatgtgaaagccactttggaactgagtaacaggcagagtttgaaatagtttggagggctcagaggaagacagaaaaatgtgggaaagtttggaacttcctagagacttggaggcctcagaaaataggaaggtgtgggaaaggttagaacttcctagagacttgttggctttgaccaaaacgctgatagtgatatggacaatgaagtccaggctgaggtgatctcagatggagatgggaaacttgttgggaactggaataaaggtgattcttgcaatgctttagcaaagaggctggtggcgttttgcctctgccttagagatctgtggaactttgaacttgagagagatgatttagggtatctgggggatgaaatttctaagtggcaaagcattgaagaggaagcagagcacaaatgtttggaaaatgtgcagcccgatgatgggataaaaaagaaaaacccattttctggggagaaattcaagcctgctgcagaaatttgcataagtaatgaggaaccaaatgttaatcaccaaaagggagaatgtctccagggcatgtcagaatccttcacagcagcctctcccattacaggcctggaggcctaggaaggaaaaatggtttcttgggccaggcccagggcccatgctttgtgcagctttgggccaccgtcctccagaccctagaatggtaggttaaccaacagcttgtgctgtgccgtgcaccggaaaagccacagacactcaatgccagccaatgaaagcagccaggaggggggctgtatcctgcaaagccacaggcacggagctgctcaaaaccgtgggagccgaactcttacatcagagtgacctggatgtgagacgtggagtcaaaggagataattttgggactttaaggtttaatgactgacccgctagatttcgaacttgcatggggcctgtaccccctttgttgtggccaatttctcccatttggagcaggtatatttacccaaagcctgtatcccaattgtatctaggaagtaagtaacttgcttttgatttcacaggctcataggcagaagggatttgccttgtctcagataagactttggacttggacatttgggttaatactgaatgagttaagactttgggggattattgggaagtcatgattatgttttgaaatgtgaggacatgagatttgggaggggccaggtgtggaatgatacatttaggctttgtgtccccacccaaatctcatcttgaattatagtctccataatccccaagtgtcctgagagtgacccagtgggatgtaattgaatcatggggacggtttcccctttgctgttttcgtgatagtgaggagtgagttctcatgagatccgatggttttataagcgtgtgacatatcccctgctggaactcattttttctcctgttgccttgtgaagaggtgccttcagctatgattgtaagttttctgaggcctccccagtcatgaggaactgtgattcaattaaacctcttttcttaataaattacccagtctcaggtatttctttatagcagcatgagaacacactaatatgctagcttaaattagcaaaccatttaaaatcaactaccccaatgtggtgaatcatacctttagcccagatatttcctctgaataccaaggacatgtttcagtgggcctattcaaaatctccacttggatgtgtccagggcttcacatgcttaaactcctggtagatgctattatcatgatcctctttcacatgtagtactccaacagtctcctaagtattctaccttccaatttattatctctgcagtaacaggactgcctttttttcaaattgcaaatctaatcaaacctcatcatcatctacaatcttctacaattaaataacttcacatcactctgtggttaaaagaacaaaaataaaaactttggatcatgaccttcaagtacctgtggcttccccttaccactttagcttcatcttcaactgtttccccatgatttctactctagtcatgctggccttctcatatgcccttgtacttggaaagttcctacctaccatgggttctggaatagtcttctcttcctctttctcttcttattcattcttactttatagatatcacctccatcagcacagtcccagaacttcaccttccctgaattccaagtctaggtcaaaaccactcatgacatcaggtccttctctttgtggttattttattaatatctattgcttcttatgagattttaagtaataatgtaaggaattgtgtctattttttctaaaagttgtatctaatttccaagcctaatgcttggtttatagtaggtattcaatataacattcattggatgaatgaattggggttaatagaaagatgtcaatcattctaaatgaagtcattctaaatgtaacaatcattctaaataaaaaaaattatttagtaatgatgtttaatgaaatcttattactttatttctaaaacctagctagtaaaaaattgacactaaaatgaagagaaaaaacatgttttagaaatatgggtttaaaccaatgatttgaataaagcactggggtaagcaagaaagggttttggataagtccaggataacatgacaagtgctaggtaatttggagatggaggaattctaaatcaaactccacctctttataactctctggaggctcagtttctctattgatgcttacagtgaaacagcatcctttaatagctatattgaatttttaaaccattgagtaatttgtagcagctttctatacaagttagtggtctcagctgtcagtggataagacaagttctactagcttctgtcttaaaacataattttagaaatgaaaattctggaaactgtgtttgatgaatgtaaatatagcctagctgaaactctaagacattggaactctgattctccttgaagagaaattgccatttgctacagagaataaaatacatggagattaaaatatgctgtgctggtgattttaaaaagccatcaagagaattaagttaaaaatcaaagatgaaactgatgaaagccagacccctgtctcattgggtactcctctctagggtagttaagatacctggatggccaaaagaaaaagttacataggctatgttcagagaatgtgaaaacagtatttctgaataataggatctttacaatttttatttcattagtgaaagtctttcattatttcccagtattctgctttcatctataattttccctcagatggccacctacattaaataaaacaaatggtactatagtgtcactgactgagaattgtgaagaatttggggatctagagttggaagaactctaatccaatttagtcaacatcagtgtacaaatatgcacattgaattagattatggttgtcctccaggtggtagcatttaacctctgaaggaggggtaaaatgtgattttaaatgttcaagtattctgggacttcttaaaggctgtgagatattgtgaagtttagttatattaataaagatattggtaatgcatttgcaactatgattttgtagaagaaaccttgcagaaaaaaagatactaagtaaaatgtagatatgaagtttagatgcaattacaaaaattgctcatattaaaatattattgtattaataatgcacccttgtaaagcatggttttaaatgttgaagtaaaacaaattactttttatcatatgaaatagtttcatttttaattgattcctttacactgaaataaatacagcaattaaattacacttaaagatatgacataataaaaatatttcttgcctttagtttgatacgtaggtatagatggtttttaaccttttaaatagtgttcacctttctaactcttgctttggcaaatatggaaaatattaggaggaaatgcctttgagaattactattatctagcgtgaattttaggacacggttagtaatagaactgagcatttaattataagatagctggtgatggtaagacacgagaatgaaaaaaataaccattaatataattatttccaaaatatagagatcattaaagtttagaatctattaataagcatttttactcaaacttcaaatcttatattaattaattttgcctttattctagctagaatagtgtaatacagcagaccatttctgaataataaaatgtggcataaatgaggtgctgccacagcacgcattggattaacagaggataatttgggaccctgacatcttaagccaggataacagacgcaggctacatttaccttaagtggagatgaaaacactaatcattatagccatttgctgttaacagatactttacagtatttattgcttttctccaagaatggcttcataacaaacattataaacacgttgcaggcccacgggaaagatttgcagtcaaatgctgtctcacgctaaattagattaacagtttcttactcgtctctaggccaccccccactttgtatatataccagctcatctcatgtccttagcaaataccgtttatttttacactcagaattataatacatatgccaagatcaacaaatagagagaaagtgagccataggttcctccccccagacatatgataagtattaataattgagtacaacactcctttccactgatctttatctgatcttcatgccaaaacctttctcagtgtagtattccaggaagctactaacaagtgatgcaacctcatatgttgaaacctctttgctattgtgggtctatgccagtactttcaagtctctttgactttatagcacatgtaggtcatgaaaaatgtggacaatactttgcattaacagataaggctgcccataactagagatcatgaatctgtgggttagagaccacccagaatgctcatgagatacgatagctcagaacccacttgctgagctctgactgatcaaggtattggcacagtctatccaaaagtagaaacaacactggcagggcaggatctgacatcaagtaaggttttctttattctgtatttgctgtgagtgttattagctgtcaagctgtcttcataattgtaagacagttcacaacatcataaaaaacttattttcccaagccatggattaggtctttggattcaattaatctgatacaggtatgacaaagcattctcttttcaaacagtttatcttagagatacctgcagaatttctattagcatatatttccgtctactctagtgctaatgatcccattatctggctatgtgttactgtaattgaaattagctacagttatatccatcatcttagccctcatagtcacagataaacaatgtggatttatagcaattctaccttggcattgaaaaggtatccctttcagtttctgccttcaggtaaaatgtatactatgtggcttactatttctgatgtgttgattctatacccttttgaaacattttttttttgaaactagtattttggatctgatattaaaattcgttctgacctcaaattcatttgcattacagtgtaatatttcctccgtaatttatgtcatatatgatctagaaggggaggtatgtattaaaataattatctcattcaatgcagataatagctttaaaatatatcgacatgcttttccttataattttttgtattcagcttgagctcccctcccctgacaaagagccacccacttatttcctgaaagaagggggtgggtgggtatattaagattattataacaagaaagcaaagacagatagtttggtttttagattttggttcccaaaacagggcacagtggtcagatgtgggtatattggcttcttcctctgtatggacacactacagaggagagtttggcagtattctcagagcagggaaagtctgacagtagcctggggaaatggaaataatcataaagattccccacattagcctaactctggagcgacaaggtgccacacaggcattaagttaggaacgcctgagaaagacgtcttgaatctgcatttaagggcagactctaaacaaccctattcattacagattgataggaagaaagtagccaagatatttttaccagacccctaagggttgggaaaaccagtaaatcaaaattagtctgggactgatgaaaagaagccacaaaatacagagatctcacagtcataggccatggcaggaacatgaacttcagcaacatatatctgcgtggaggacaaaattttgtaagaggtgcagccgcatttcagtgtgcgctgtcacaggacacgaacagagacacctcactgaactggagaccagtagatattcagagcacattctgcagttcacaggattcttccctaagatactaactttgaaatagagaatatggcaggcctactgaaagcaggaaagagcatcctgataggaaatttgaatgttgtattaaatccgaagtgtcaggtctatgtgaaacaaacaccagataaaaacaaaataagacaaaaactatttcaacttgaataaaacaaatactttaagaaaaaaatcaattgagctataatttacataccaccaaatgtattcattttcagtgtacgattcaatcatttttagtaaatttacagagctgtacagcccttaccaattccgatgatgaggaggggtggaatgggggcagggaaattaacaattaaaagtaactcacttttacaacatttcaatcactttattatacatacgcatacagttatgcatatatacacagattatatttatgaacatttatatatatataaacataatgaacctcttctataaaaaagtgtttatttttcattattttatcaattatttatataattcattcatttaatgatttttatattgagaaatatggagaacacaaagtagaataaaattgtctttctgtttaagaatttcatagcttggtgtgaaagatagtcacgaaaacaaataatgacagtacttgatgaaaagttttatgacagatgtattccctggaattatttcatctctttcatactccttacaaccctatgaaataagccaagcatatgaatatctacattatatagataaagactctgtagaccacagcagttatagtagcaaacatagtgagaggaaaaaacagaagttaattctagattttttgatacttaaaacattcacatatatttggccttaaagacagtagattttctctaccgaaatgtaacccagtttttataaatgttactgaggcatgctttttttttatttttgtggaatttgttattatttttcaacctacaataatctattcaatacccactctgccaaataccgtgctagccatgtggcgcctccaggattagaagttcctttgctgttatcagttcttatagagtgatgttgaattgtaggaatgtgagaatttggcctccttactgataagaaagactattaggaaactttccaacctgttggaggcaaatgagcgttaatgcaaaagttgacttagaaaaagctttattctaattccagcttggccatattctagttgcgtgaatttcagcaatttgctttgtctctctaagccgatttttgctttacaatggggatacaaataccaacctaacaggtgaaaagtaaatgttatataataaaagtgctctttatagtaccttcctcataggaggtacctcttgattatttttaatgaatgcattagtacacctaaatcacctgcatatatttctgaaccctctaagcggtatattgtgccttgattttttaaaaacataataataacctgtaatcctagcactttgggaggcttaggcccagctattcaggaggcttaggtgggaagagcacctgagcccagagaggttgaggctgcagtgagccatgattgcaccactgaactccggccttggtgacagagtgagaccttgtctcaaaaaataaaaatacaagtataaaataatgatgcaatccctgccttctggtagcttacatttgataaattaagctgaaaagaattgtgggtatgcaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaaaaaaaaaaaaaaaaaaaaaaaagaattgtgggtatgaaataggaaacaagcagacaagttacatgagtcacttagaacttgagttcttcttataatatgggttcaaattacctgttgccaggtttaaggtgaatcgtttaccatactgttttattttccatggtctaaactgaaatgtatgcactaaggtcagagaaccaaatattagctttaattacacaatagatatattagagaatgccacagactttttactgttttcctacaagtctaaaccttggcccctacatgtggggataattgggtctgcaatctagttgcttgcataatcctagcttgccttacagtgtagtgagagctccaggtaaagagcacaagtgagcttcaacatttattcattttcccctcgcactggggaaactcgcaccaaggggttagagtcagattcttgccatctaacaaatcagatgaatcactcctgctcacatagggagaagcttgtgagagatagaggaagagcaacaatttctacctacagaaattattttacagcctgccattaggtgtccaaggagagagagagaaagtttcactctacacatctgaggtagaagtttgataagaattaaatgagggtgtatataaaacaccgagaaaactgccgcccctatattacctgctcagtcaaaggtaatatactctgatgtgtacacaatctacatttgcaggaagaatcctgagacccacagcaaatcagcaatgctcctcatgggagaactccaaatcataccccatctctgactcttaggacctttgataagatggttatcttatcaaagataagaaggggaagaaggggttgctgtgggctgtaggaactgtgagggcctcagagaagtcatattttgaactggtgagtcaaaccttgaggagaatgttaacataaagagcttctcctgtctccgtcaagagacataacctctccagtctccgagctaattcaggggcttgaacccatggcctttggtcaacttcgagctctaatatccagaggtggtatttgtattgggttacctgacaatgactggactaacttcctcctccgacacacaccagcaggtgactgggcctccctaaacacctcatgattcttcttccacagcctggcttttgagtaggacttattccacaactgaacagttggaattgcttctgatcatatgtgctgaactgcttagcatttatttaattctcatttcttactgtgtccttaaatctctcgattcttaactagaaaagtggaagtcaagagggagcactactttgattgtctccacccatttcaaaatgtcaggaggtaataaagggggctgtctgaaacctgaggagcttctgtactgtttctgactgagaagtagggatcagagctgagtgtcaggtatgaaattattttcagtctctggcttgctccagcctccaagttctgttcacgtcatgccttctcagactattaacagaaggaaaagctgaggttgtttttattgttctttgttttgtttttttaaaataaagtaaaaacagaatgatcagaacataacactgctgctgaatgcacaaggaaccatcttatcaaaggtcctaagagtcagggatggggtatgatttggagttctcccatgaggagcattgctgatttgctgtgggtctcaggattcttcctgcaaatgtagattgtgtaaacatcagagtattggctgccacagtcagagggaatgtaggcatttcaaagagttttcagtttatgcgtcagcaattgctgaaaactcacccttcaaagtacagatattactaatgccctgtttctgctcttaattgctaattatacaatctgtgtaaatgcaagatatgtgactcctccagctctgcaaatgtctttgcagctgcctgtacactcaaattaaagcccaatgcagctgtcctagaggtagttttatgtgattccctgaatggacaaattctattttgaatgctgttaggagtctctccctgcaccactcaaaagtcacttacattacggttgctttcttcctgttcagcatgtcttctcttcctggatgaagtgagaaattgccattttgctgttccttgctcacttaaatgtgagttacacaagcctttttaaaatttcatttcctctcaggaaatgttttaaaatatataatttatttcttttggtacccatccagaaaagtatatttagctctttttaatgcattgcctatatagaatgtgatttttttcttgagagccttatttcattgagtacaaacctccctttatatttctagcacattaatgttataaaaattagtactttcccgtaccctgaggaatccaggtgtcagcaagtgttaccaaaacttgggcatatgattaattggcttgagcccggatgacacaccctgtggtagcctaacacactcttcaagacgttcatcagttcacggagatattttaatgatcaccactgacatgggaatcttgctccgatgagtcctgtctctgttccctcatagtatcaattcaaatacataacacagcttctctcttggttttcataaaacatgccacaaactctttggaaatgtagtcgagtttattcaaggtttgtgaaggatagagactgaggaaagaatttgcattttcaaagtaccaaaaagcttaatttcagtattagatatctgtattctaaaaacgctcaccaaccacccgtctctggagtatttgcacagacactttccttccatgcagtttctaacatcacaccatcatgccatactggctactttctcttctcttcctcttcccacttctcataccctccatccagtactgcatggagaaatccaaattctttgcctcatgttaggcagatgtgtttgtctctctcagccttgattctcaagcctgcatatccaaacccatacagctacacagacgtgaaaaatgaatttctaagtagaaatagacgggattcatctttttagaggagacttgtaggtacaaagaattatttttctttcactgttatacttgcatcaactgtttgttgtgagttcttttattcattcaacaaatacagctgtcctctcattctctgtatccactgatttcgcatctttggatacaattaaccacaaattgaaaatattttaaaaccccaacaaaatagcaattacaacataaaaattatacagataataaatgatagagtacaataactatttgaatagcatttacgttgtgttagacatcatacgtaatctagagatgattaaagtatacaggagaatgtgtgcaggttatttgcaaatactataccatttcatataagggacttgagcattcctggcttttgatatccacagggatcctagaaacactctcccatggataatgagagatgattgtattcttttaatgcctattatgtagcaaatttcaagttagcacttgttctgggataaatttgtacctgttaataggagacagtataaacatagtagaaggaagccttagacacagaggaacttgattctagttctgattgattcatgctttcactttttctttccaaaaatggttgatgtaacctactctgtttcagcaagatattagatacagggaatgctgaaattatttagagcccctactctcaaacattgtagaatagagtaggaaagacagatgtatatgctggaccgtaaactgagcaatctgacctttatacaaatcaaggttgaatgtgtctttttttttcagagcctgtgtttacttttgactagcgaagagctttcagaaaattaatgttttctcaaatgaaatcgattggcagaaatcagagggatagaggaaatttattcaatgcagagttgacttaaactgcggtgaatgtttactttctggggtcaaaaatgcatgtaccggtttcttttttgttaacatttaatatttcctgttattaataaggaaatgttgcacctgaagtaaattaaatcaagatggaatgtataatttctttgaaaacaataaaattgttattgcagatgttattaaactattagtcaatgtaattttgtcaggattatgtactattgattaggaaataacctgatgaatcatttggaaggatgctttttatttttagctttgactaacaggagtgtttgacagaagcaagttaaaatagtgtgttatactgctacagctatgtgaatttacattaaatgctttatttcagtattttagtatttgctgttaataaagaaaattaggaatctgaactcattttagttggcctttgaacactttgagtttatgagtttgaaaacaacttcaaattaaagatacattgtgatttcactggggaactttgggtctttaaaaattcatctgatggagcatggtgcagttaggccaagtttgcaaagacatatgaatctggatcatatggaccaaaacatttgcttctcaagtaaaatctagctagtcccttttttccatgttacatatgtctgaatttaaattccctatgtcttccatctcgaagataccaggttgttttttttttagctctgaattgtttccacccattatctttttaaagaattcttcgattgtatttcccttttattataaaagcactgttttataacttttacataccaatctgtctccagtaccaatactacctcttttatgaacaacctttgtttagctgtcttattcacatatgtacctatgtgcctttgcatattttcaactctcaataaatgctttttgaatagaattcccatagctaattaaaagtgtcagctgttaaaatggacttcacacttctttctcttgaggtgaacaatgcacactggggtctgagaaggtggtttcttaatctcttactcttagcaggatacccaccttttcttaagtgcattctaagtttctggagatatataggattgcagtccagaagctgtgctgtaactaccaattctccttagatttgagtgaggttaacagagtaaaaacatgatgttttgtgaatgcgccttctgtatatatggcacctttctttatcttcagataggatcagtgttagtagatatgggttttctgtgaagataattaaaagccatataatttcacaggtatatatttggagaggttttaaagaccacatgtccaaatatataagcttttgtttccacaaagtctggatccactccttgtgattagccccattttacagttgagagacattaaaagattatgactgatccagaattccagagcaatatattgagaaaagtagaaatagtaccctgattgacgcttcttagtttctaggagagagaaaattacatgaaccctttacaaaaagaagacagaagataaaattcagaatttatatcaaattatttggctctgagtcaaatttcatctgcaagaatattatgttccaggtgtttgccattgggacaatttaatgtgtttaattagaaaatatattttaaaatattactaggtcgctcagctgtcaaaattatgtaaataaaatggtaagtgaaaataattataaaaatatttaaatgtccttatatggctttttaggaaatgtgcttcattttctttctacacaacccaaatgtccaacagtgatagactggattaagaaaatgtggcacatatacaccatggaatactatgcagccataaaaaatgatgagttcatgtcctttgtagggacatggataaagttggaaaccatcattctcagcaaactatcacaaggacaaaaaaccaaacaccgcatgttctcactcataggtgggaactgaacaatgagaacacgtggacacaggaaggggaatatcacacactggggactgttgtggggttggggaagggaggagggatagcattgggagatatacctaatgctaaatgatgagttgatgggtgcagcacaccaacatggcacatgtatacatatgtaacaaacctgcatgttgtgcacatgtaccctaaaacttaaaagtataataataataaaaaaatacatttttcctgggttcttcgggaatgtgattgttatagttacaaatgtatgcatatttttaaagaaaataaggttgagtttcagcctaggcaaactgctgaacccaaaaatcactgtgagaattttgattagtattctgtagatggttttcagtctatttttgatattttagcttagacttttgaagacagttgagaaagcattttttaacaacgagaaattcattattcctaaattaaaagataaagagtggagagtagatgtatggttgacattttacaaatcaaatactttagagttaataatttctacctgacactctatgtaacacagcattcagttgatggtaatttgttatgtttactgatcactattaagctattaaatgtttttaaaattaattattttattattttctgccatgctaattgcttaaagaagaagagcagtgattggagtggtgaaataaaacaaaataaaacacagacagtttattgtcataatatttctaaattggaagtaagtatagccgaatgcctcttatacaaggagtcagaagatctgcagttgttttcacatttaaaaacctcagcatccttgcacaaatcacgttgcttttctgacttttcaattcttcatctataagaataaatatatattactcttaccttatcttcatagcttttgttaatatcaaatgagtaatggaaatgaataacctatacaattgtaaattaataatgatgtggttgaagacgattcaaggaaattttaacagtctgtgtagtgatccaaatttggctattctaaacaattttctaatatttaaattgtaagccatgcacatttcatgatttaaatatcaatcatatgtccacttactcagctaatatttatttagcacttactgtggaccaggcaccatgcaaagctttaggggctccatggcccacctacaccgcacatgatcatcttctagtggaaagagctggagagtaacatgtgtgactctcatattatctattttgctagaaaagagtatgaacatatatgtatacttttatatcttattgtaatatcctctaactgaaaaatttatccagtagtttcttctctattttgtatacaggtctttggcctcacatatgtaggacatggccccaggagtttaataatcactcaactgagtatgttaattaggaattaagtaattgtattaacaattttttgattgaaactagattgagagcaaaaattatataactatgtgagatcaccaaacacccagagaagtcctgggaataacagtagttcagtaaatgtggaatttgcattttaaaaaggaaacttgtctgaggcaggcggatcacctaaggttgggagttggggaccagcctgaccaacatggggaaaccctgtctctactaaaaatacaaaattagcgaggcatggtggcgcatgcctgtaatcccaggtactcaggaggctgtggcaggagaatcgcttcaatgcaggaggtggaggttgcagtgagccaagattgcaccattgcactccagcctgggcaacaagagcaaaactccgtctcaaaaaaaataaaataaactaaataaaaaggaaacttgtttatataatgaagtacttagaccctgttatttttgccctgatatattttacttaaaggaactttctaaatatatacgtgtgtgtgtgtgtatatatatatatatgtatattatatatattgtatatatatgtatattatatatattgtatatataatgtatattatatatattatatatatatgtatattatatatattgtatatatatgtatattatatatattgtatatatgtatatgtatatatgtatgtgtatatatatacacatatacacatatatgtgtatgtatatatatgtgtgtatatacgtatatatacatatatacaatttttgtatatatacatatatacacatatatatgtgtatgtgtatatatatacacatatatgtgtgtgtatatacacatatatatgtgtgtgtatatatatacacatatatatgtgcgtgtatatatatacacatatatatgtgtgtatatatatatatctcccttttcaaccatattccactatctccaaacagtatgtttaatatagtcacttgttctatcgagatccccactgttttcttgttacagcaatgtacataactctatgtgatatggagcacagaaatttataatgcttgttttcagtaaaagtggagaaagaagccattttagggtatacatagcactaatcacaatgcctaaataacttcataataaataacatataaagaagaatgaaaaggtagaagaaaagaaggaagtgagggaggaagggagggaaagagagaaaggcaaactacagtggtgtgtacagaggttcattaaatgatagaaaggtaaacagtgctccctactaaatcttttcattctagtctcccaaaatattagtgtggcatcagccaatttcatgtctaaaaaactgtctcagtttattactaatcacaccaagaagcaagtgtgttaataatttataatctatcatcgagacaagcttttactgtttctaaattatttaaaatgatctgttttctttgtctgcctgtttatttaatcaatttaattcttatatattgttctatttaaaacttcactagttgacatttagtcatttgctgtcccaagtttgagttgaaggatggaatttttaatgagatcctttcaatcattcaacaaatatttttatcacctatacttctggatacttagcatatagcagtggaataaaacggaggaaaaaaaaaactattattgtcctcattgaagttatttactagtaggagaagtgatatggtttggatctgtgtcactgtgcaaatctcatgtcaaattgtaatacccagtgttggaggtggggcccggtgggggtgattaaataatgggggtggattttgcccttggtgctgttctagtgatagtgagtgagttcttatgagatctggtcatttaaaagtgtgttgcagcttccccctcgtctctctttctcctgctccagtcacgcgaagtggctcactccctttatgccttctaccatgactggaagcttcttgaggcctccccagaatcagaagccacaatgcttcctgtacaacctgcagaaccatgagccaattaaacctcttttctttataaatgacccagtctcaagaatgtctttatagcagtgcaagaatggactaatacagggagatgtacccaacggatgaacgagtgaaatatttaaaatgtcagaagaaaataaatactatgcatacagatgaacaaagtaaggaagatagcctgtgacaatggagtgattttattttaagtagggtggccaaaggacgcttatttgatttaatatttgagtagtgacttgacgaaagtgacaaactgacacatgcaaatatctaaggtaaaaggttacaggtggaggacacaacaatgactaaggctccaaggtgaaaatgtacttggaatattgaggtaagtcaaggagtccagtccagctggagctcagtaagcaaaaaggaaaaggtaggaggtaaagtcaggaagtcagaaaaaaaattatatatatataggttattataaagacattgtcttctactgaatgaaagtggaagccattgaagggtttggaatataggaatgatagaatctgacaggatctgacttttgttttcagagacaaggtctcactgtgtttcccaggctggaatgaagtggtgtgatcataggtcactgtaatcttgaactcctgggctcaagccattctcctgccttggtatcccaaagctctgggattataggtatgagtcaccatgcctggccagatcttactttttaatgtaatgattctgggatttcattcaagatagactaaagggtggtaaagactgaagtaaggagactagtgaagaggctatagcaagacatggtggtgacttacaccagtatcataactgcagaagtaatgagaagaatttcctaacactcattcttgtatatgagacacacacaatgtctcgaagatgacttaaagagttttgccttgaggaaatgaaaaaatgtagttgccatttaataaaatatgtaaaatttcaggaggaataattttctggcattttggaatggaaatcaggagttggtagcagtcatgctaatgtttggatgtttacaatttcataatgtagtctctattaaccttacaagtcctgtggtattgaacataaatttctattatcctttagaagcttcaaagcactaatattttataaccattaaatttttacttgaaacattttggatcaaatttcttattgtttttgtttttctacttttcacatagaactcaaaaaatggacttttaaccttggtagtaatcagagggagtcttgaatttgaagtgatgctaaacacccacacttcatttgcatttatttactgcctttatttttgcaatttttaatttcataaagtgtctcaggacttcctataaaggtgtacgtataaaaatagtctcatataatcacaccttgcagagataactattgttttcattcatattctttcttatcactccataatccattcacaactcacacttgtgtatttattgtgagaatgttatataccaggaactgtactaaatgctttacacggattggctagtttaagtcatacaacagccttttatcagtcatgttattacttgcagataatgaaaacaaaccacgtagtttacacattaaaaaaagtattaaagaatatcaacttaaagatttcccagaaattgcaaatcatgctgaggtgctgtacagatggacaatgtccaagactgcaggacatatttggtctgatagaaaggtcacaattgcttctgcgattcacagacaatgcatgtgacaccaccaattctcctagcactggacactggatattacctctgaaatgtttgcatctgctttccatggacacctatacatgataaattttcttacaatagagtaagtgtgttcaaattctgggaaaccaaaaatactactggaatggtccacgtcttagactgcccaataccagtgtattaatatgtactcagtaatagagactcagataataaaaccaacccctgataagcaggcaaataggaaagcaagactaatttattgtctctgcaaaagagggtcatccaaatagttattatttttatgttgagctgcagctctcatcagcaggtgattgtgattcttctataatttcattacaatttacctcaagggactaaattgggaaggtcaccaccatcaatgaactcctttttaaaaaattactagggaaaagagagaggagaaacacacaaacacacacacacaatagttagcatagccaatcatatacaagaccctgcacagcatccatgctggcaagggtggtggcagttacctccagtattcaaaagcatcaaaaatacatagttattaggttattaaacagaaataccaaaatttatgataagcactgccgaggagtgggttatatttctagctctgaaatctaggatccatctcttacgtgttctgtgtgctggggaaagttgcttaacctcactagccttcagtttcttcatctctaaaatagagacatcaataatatacctatctgatagaactattattgtaataatatgaaataatgcatgtgtcttctattcaaatgtaacttgtttgtgaattaaattacactatgggtacatctgattatctgactggccctgaagaggaccatgtttggctgctcttgcgagtaaatcagtaactcaacagtggcagtagccaaatgagtgataatgaggtgaagtttcaacagcagaggttgcaatactttacgtgttgtatataactcaggattctttcagcaaaagaattgttatgactataaaaactaagaaaacaaatttaaaaatagttttctagtggaaaaatgcaaagatatactttatatctgttttgtttttgtagcatatataatagagaagtagtgtgggaaaggtcacacattgatacagcagaagcattggaataataattatgtctagcaattagcaaacatctatcatagttcagatactatactaagcactttacatatataatttcgtgtaatcaacatagcaatttttgaaaattgtggaattgaatattagagaatataagtaccttgccctaaagtacacaatttaaaatggccatctaacttctatattatcgtggtaaatcaggcacttaatgatcagatatgtaatatctactttctgccatagtgcattcctataaactgcaagacaaagcaaataattgtaaaatgaatggtattttcacaaagaaacaatgccattattgaaaattgtgttcttaaccaataatatgacattgaagacatcatgtatatataatcaagaatatgtcataagaacaaagaaaccgtgaccataaaatgtgctaaatctgatagatattaattaattatgtatttgatgagtaataatgctgcttctcttttttgaacttaggatcttgaggaatattttcagtggcttttatctctaagaaaactctcaagtggggaaaaaaagcaacttcaaagctttcttctttcttgataaatgtcctttacttttgtagtcatttagaactactccactgactatctttttaagttgctatgatagcatctaatattggggaaaaaaagaaaaaaaaaagctttgaatgtagtaatgtagaagacctaatttctaggttcgtctctgctggaaattacctacaacgcccaagcagtagtgcttcttttctgttcctgactttctccatttctacgaagacactagatttggtgaactctaaaggctctttcagggatagaactttctagaaactggtatagagtacccagtccttggatactgatctaagttgttggagagcagacgttttctcagtctggttctgttgactattgattcttatttgtctgttcttaccacaggatcaaatcatgaagggaatctcttccaggttatatgacttgctttggtcataactagtgtttacagacacatagtatgatatgtcatagtaaaataagaaggaatctagaagttttgaattcaaatcctgtttcttcatttactgagtgaccttcaactaagtcacttaacctccttaaacctagaatttcccattaataaaacagaggggatagttcttttcctacagggtaatgataaaaattatgtaaataatgtatgaaaacatcttgtgtgtatctatctccttatgatagttataggctgatgtagaaagtcaaacccacgggcatcttgataatttgttagaaagccactccctaatgggacaatgtgcctagacaaaagagtttggaagtaaggtagagatgctaattagctgtcaactgattttgaactgatcaacataacaaagcttaaatagactctattgctattatcagtgcctgttaattcactcagagtatgtgagcaaactataaacctgcaaaggattacagaggatgcttagcgcagtgaagccctgtactgaatgaacaaataagcccccagggaagcttttaaaaattaccagtttctagagccggtccctggacattatgattcaatagatgaagtgtggtggctaggagtttgcatgttaaagaatcttcgtagaatatcaatgaacagccaagattgagaacacctgaactgatcagattcctcattttacaagtgaggagtatctggcagagggaggaagattgagatcccaaagcaggaacttgaaaaaaagttctcctgatacttaatcctttgttctttccataatatcacatggcaaaagacagatagtagagtcagtggtatttcctgcaagccaggaccattgtatatggtatcctggctgtctatgctgaagtcaggtttatgttctcatgcacataatgtgagccatggagtgctggggccatttgtcagagacaaccttctacaatgtcacattaccaggttgtcaatagtgtacactcacctgaggtaggctgccacattaaaatgggacacaatgacaggggagaatctagatgtaaaattgaaagagtcagaaactgcccacagtcagaggaagaaataagaagtggaagcctggaggcattttctgatattgccttggtgtttgattgtgattctgtttctaggcatagcaaaaggaaacaagactgacttgatggtcaaggtgatgtaagtagatcagctggcttccccaatttttttgaaaccaaaaaagtaggcccggcacggtggctcacgcctgtaatcccagcactttgggaggctgaggcgggcggatcacaaggtcagtagtttgagaccagcctggtcaacatgatgaagccccgtctctactaaaaatgcaaaaaattagctgggcgtggtggcgtgcacctgtagtcccagctactcaggaggctgaggcagaagaattgcttgaacccgggaggcggaggtttcagtgaaccaagatcgagccactgctctccagcctgggcaacagagctagacttcgtctcaaaaaaaaaaaaaaaaaaaaaaaccaaaaaagtaataggtttatatgtatagtaactaacatattataaagttcattaccagaaagtttatatcttggtcaaatatatttacctaaaaagtggaatatgaatattaagatacagtattaataaagtcattaaaactcatgatttgagagaaactagatctgtagttagaggcaacaacagtttattgcatggaaaaatctttccaatttttagttctggttaaaatccttctggggtagcggctttttgtttctaactttaaaaagttcccatacacaatcaattgtactattttattcattttgaaatgtttgacagtggaaggactgggaattgaaagactttgattgcaatcctgacttgccgtggaccaatgtcatgaccttgcagaagttccttttccctagactggtccccattgtactcactggaaagacatgatctcaaagggctcttcaactctaagagtcagtaagagcaaaggtttgggcagagatgaaaataagatagcagggtgcatctgggaggtggaggatggaattgaatctgatcccaatgcatctgtggggatcagagctaaaatcaataatgtatgctgttgtttctttttatctttttttcttttttttctcctaatgtctttccccatcttttcctgcctttttaatattatgtctcctaactctagctttaactcctgaattatattaggattttgttaaagttcatacattttaagcaaagagatgtagaaaattgttaaggcttaaaatgaatttcaacactcagtaattgcatatcctctgcttcctactggaagagaaagaaacttttcgtggactggagggcaggagaatgagaaaaaatgtgttttcttcaaatttctatgaaaatgtgacagcattcatagggagacaaaaaaaataaattagaaaacctgataatccttctggagcagtgctttttctttcatgaaaggcattgtgaatcttcacccatagaaacattttgagcacaattgaatgcatttgtaatttttgaatcctatatttgaaaaacatttgaaagccaaagtactaaaatctaaagaaaatgcttttctatcggcctcctatcatatttttatactgtgatagttacataacttgaaacatggtgtttttaatgtagtattctcaagcaattgtttagggaacaaagactcaccgtatggtacactggaaaatacagcagaaattttgaaatcagaacaaactggactgcaatctccctcccacttcataggtataacaattttggaaaatcactaagctcctagttttcttacttgcttctcgtgaaggtagagtgtaatatttgtacaagctctttatgaacaatacaggttacaagagaaagggaatgtgttgccagccaatcagctcctcaaatgtgctttcattgggtggcaacatctctaatgtgaaattgatattatctatatgtgattactaagatcatgacggaggtgattcttttgaagtatcctcagtgcagggtttggcacagactagttactcaatacatatattctagccttttctttttttgcttacacaacgttaacttatgggtataatagtttaattatcacatgatcacacttgagttgttattcagaataattttgtcctcagcaaataatcagaacattaataggcaatgcagatagagagtttatgagtgaatgacagcaactggcccaacttcttcagcactaggtttctaataattcaagcctgcagattgtgctgtatttttattcatttgcactgcaaagttttttttttctgttaaatccttgttatttggccctgcatcatttcagtaaaataaacttggctccatcaaattcattaggcaagctatgatgtgggaaaagtcaaaatttatcttccctgaagctactttcagacagtaccttaagctgggcattttaaagtggtgtcagataaacttggcagccgtttctttccacagatattcttagttgaagcttttggtctcttcttcactcatgggatggttcctcttgccctggttgcagaatagcgttcgagcagtgaggattctcagcttttctgttttacagccctagagacttggctgctgcagctgggtatcaagcaatgattttcacatgcctttttcatcactttttttctaggagaagattgcttttgacattcatttttaagttacatgtcgttttccaagagtatatctctcacaaaagctttagaatgccagtaataaatgtattagtagctaagaagctcagtctggcaactaccttgtctgctttaagtcagtgtgaaatacttccaataatttaactcttcttaaacaatcacttgatgtaatatttaaatctaaacattaaaatcttctgtggtttttgatctgtattagttcagtactacatagattaaatatttgatatctgtacctgaatttgatctatactcagccagcaggagaaatcgaagggagcattagatactcgtttatttatttattttaatttattctgaaaaatgattaacttacttatttgtcagaattgattgtttaaatgaattgacttgattgtactcattttttggtgttcggttagaataccctcaattgacagagtcactggtccagcagcttacaagtataatcaaaatggctatcttatgtagaaaaggcagtaaaggaatgatattcactgggaggccccttgtgtaggtcaggaactatgttaattattacatcttatttcatttaattcttgcaatgatcttaaaaggtaaatattatcctaattttcaaaggaagcattggaagcagagagtatgagtaacttctgcaacactctagagtcaggattcatacttaagtcagactccagtctacaggaatgggccacaacaccaagctcctcaatgacttgttttgctcttgtcctatcttttgtgcacttacatctttatcactatgttcaaaactaaaatacaattttagtgcttattttatccagttttattttttcaggttaataccagccacagagcaatttagattccccatctccctttgaaaaatatacaattcaataaccatacatgtgcatgtgtctttataatagaatgatttatattcatttgggtatatacccagtaatgggattgcagagtcaaatggtatttctgggtctagatccttgaggaatcgtcatactgttttccacaatggttgaactaatttacactcccaccaacagtgtaaaagtgttcctatttctccattgcctcaccagcatctattgtttcctgacttttgaataatcaccattctgactggcatgagatggtatctcattgtggttttgatttgcattcctctgatcatcagtgatgatgagctttttttcatatgtttgttggctgcataaatgtgttcttctgagaagtgtctgttcatatcctttattcactttttgatgggtttttttttcttgtaaatatgtttaagttccttgtaaattctggatattagacctttgtcagatgggtagattgcaaaaatgttctcccattctgcaggttgcctgttcactccgatgacagtttattttgctgagcagaagctctttagtttaattagattccatttgtcaattttggcttttgttgcaattgcttttggcatttttgtcatgaagtctttgcccgcatctatgtcctgaatggtattgccaagcttttcttctagggtttttatggtttggggttttacattgaagtctttaatttatcttgagttaatttttgtataaggtgtaaggaaggggtttattgcagcactatttacaatagcaaagacatggaaccaacccaaatgcccatcagtgatagattgaataaataaaatgtggtacatatacaccatggaatactatgcatccataaaaaggaatgagatcatgtttttcctgggatgtggatgaagttggaagccatcatccttagcaaactaacacagaaacagaaaaccaaacactgcatgttctcactcataaatgggagttgaacatttagaacatatggacacagagaggggaacaacacacaccaggacctgttggagtgtggagggtgaggggagggaacttagaggatggatcaataggtgcagcaaccatcatggcacacatatatctatataacaaaactgcatgttctgcatgcatatcccatttttttagaagaaatgaagaaaaaataaaataaaaagactttaactcagcttcgtatcctcaaaaaagagaaaaatatgcaattcaaatttccctatgtacaaactaaattcttaaaaaagttaaaattttgtcttaaattacaaattataaatgtaaatcttaaattataaattcttaaaaatacatgtcccccgtagtgagaaagagctgcagttaaaacagtggttagcaattcccagtctagtagtctaacaaatagataccttgtacattcagtgttttattttgcttttcattgtgttaaataatttttactaatattcacagatttcaaatgaggacaatttaaaaatataattagctcagagcagaattccacaaaattagtccttcatgcttgaactgagtgacctgttcatgtactaacaaatatttcagtgtccatctctgaagggcaagatttcaagtctcaaagcttctcacattgcatgtactgagaaactatactcctatgtgattgtcataaaactgaatcctaccaatgaagacgaaatgataagaaattcataagtcctcctcagagacagaaagtacattcccacccttatcacctcccataattgttaaggatgacaattattatagttatatttattgaactcatactatgtgccagtaattgtgctaggtgctttatatacaccctactggctgcctttttaggaggtattagtaaccttatattctttgattcagtaatttcaaatgcggaggcttacaacatttgtcattcaaaaaaaatcactcactgactctaaagtccatgtttttgtcaccatgttgtagctgctccatttaaataaaggtgaaaggagttgagagatgtgtctgctatgtacagcatctgagattaaagaaaagaaaacaacagaacaactaagaagtgtccttacattttttttattcagaatcagaatcaatcagtgatggtttgtaaacatctacagatatgttttgcttcttttgttattacttagggtgttgagagttacagtttatagtatcatgtctttttttttaaagaaaaaaacaattctgtctttggaaaaaaaaaatggaaacctacttatagtttaaaagggtcatttatatcaaagcacatagagccagttcctgagaattttcactgattttgtgtatgacttcccagaaaagccttgtccattccaataggtgacataagaaaaagtgatattctgacattttctatttgctatagatacatgattattaaaataaattcatattgtattcaatttttaaataatttggtaatgtcatttaatgtcagttagttaaatcatataagcttatttgtaactgttccttatattttagaaatgttaatccattattatttgttctttttacttttgagggttttatttaacttttaagttcaggggtacaagtgcaggtttgttacataagtaaacttacgtcatggggggttattgtgcagattatttcatcactcaagtatgaagcctagtacccattagttatttttcctgattctctccctcctgccaccttccaccctccgataggcccgagtgtgtgttgttcctccctatgtgtccatgtattctcattttttcactcccacttataaatgagaacatgcagtatttggttgtctgttcctgcattcgtttgctaaagataatggcccctaactccatccatgttcctgcaaaggacatgatctcattccttttattggctgcatagtattccatggtctatatgtaccacattttatttatccaggctatcattgataggcatttaggttgtttccatgtctttgctcttgtgaataatgctgcaatgaacgtacacatgcatgtgtctttttaatagaataatttatactcctttgagtatatgcccagaaataggattgctgggatgaatgacatttccatctttaagtctttgaagaatcaccacactgtcttccacaatggttgaactaatttacattcccaccaacagtgtataagcattcccttttctctacagtctcaccagcatctgttattttttgaatttttaataatagccattctgactggtttgagatgatgtctcatggtggttttgatttgcatctctccaatgatcagtgatgttgaacttcttttcataggattgtgtgggtcacatgtatgtcttcttttgagaagtgtctgttcatgtccatcacccactttttaatgaggtgggtttttttttcttgtaaatttattaactttcttatagattcaggatattagacctttgctagacgaatagtttgcagatattttctcccattctgtaggttgtcgggttactctattgacagtatccttggctgtggagaagctcttaattttaattagattccatttgtcaatttttgcttttgttgcaataggttttggcatcttcctcatgaaatctttgcccatgcctatatcctgaatgatattgcctaagttgtcttccagggttttttttatagttttgggttttacatttcagtctttaatccatcttgaattaatttttgtataaggtgtaagaaaggggtccagttttagtcttctgcatacacacaatcctttccccattgcttgtttttgtcaagtttgtcaaagatcagatagctgtgggtgtgtggtcttatttctgggttctctattctgttcctttgatctatttgcctgtttttgtacaagtattgtgctgttttggttactgtagctctgtagtgttgtttgaagttgggtagtgtgatgcctccagctttgttttttttgtgtgtgtgtatgtgtgtgtgtgtgtgtgtgtgtgtgtgtgtgttttgcttaggacttctttggctattcaggctccttttcagttccatatgaaatttaaaatagttttctccagttctgtgaagaatatgaatggctgtttaacaagaatgtcattaaatctataaattgctttggatggtatggtcattttaatgatattgattcctcctatctatgagcatggaatatttttccatttgttcgtgtcatttatgatttatttgagcagtgttttgtagttctccttttagagatctttcacctccttagttagctgtattcctaggtattttattctttttgtggcagttgtcaatgtgagttcatacctgacttggctttcagcttgactgttgttagtatacaggaatgctcatggtttttgcacattgatttgtgcatactgagactttgctgaagttgtttatcagcttaagaagtggttgagctgagactacagcattttctacagatagtatcatgtcatttacaaacagtaagagtttgactttctctctttctatttagatgccttttatttctttctcttgcctaattgccctggccagaacttccaatactatgttgaataggagtggtgagaaagggcatccttgtcttttgctggttttcaaggggaacgatttcagcttttgccaattcagtatgatgttggctatgggtttgccatatatggctcttattattttgtggtatgttctttcaataactagtttattgagactttttaacatgaatagatgttgaattttttcaaaagccttttctgcatctattgagctaatcttgtggtttttgtctttagttctgttcatgtgatgaatcacatgtattgattttcatatgatgaaccaaccttgcatcctggcgataaagcctacttgatcgtggtggataagcttttctgatgtgctgctggattctacttgccagtattttgctgaggattttgcattcatgttcatcaaagatatgggcctgaagttttcttttttgttgtatctctggcaggttttggaatcatgatgttgctggtctcatacaatgagttagggaggagtttcttctcaaatttttggaattgtctcagcagaaatggctccagctcttcttggtacagctggtaaagttcagatttcaattcctctgatcctgggcttttttgggttggtagactacttattactgtctcaatttcagaacttgttattgatctgttcagagattcaatttcttcctggttcaatcttgaaagggtgttatttgtccaggaatttatccatttcttccagttttttttttttttttagtttataagtatagaggtgttcataatatcctctggtggttgtttgtatttccgtgaggtcagtggtaatatcccttttgtcatttctgattgtatttgaaccttctttttttttctttatttgtctagctagttatctatctatttcattaattttttttttcaaaaaacaagctcctggattcactgatgttttgaatagttttttgcatctctatctccttcagttcagctctgattttggttacttttttgtcttctgctagctttgggttttgtttgctcttgcttctctagttcttttagttgtgatgttaggttgtttgagatccttttacattttgatgtggacatttaatgctataaatttccctgttaacaccgccttagctgtgtcccagagattctggtatttttttttctttgttctgattgataaattacaaagaacttcttgatttctgccttaatttcattatttcccccaaagtcattcaggagtaggttgttcaatttccatgtaattgtgtggttttgagtgaatttcttagtcttgatttctaatttgattgtgctgtggtctgagagagtagttgttatgattttagttcttttgcatttgctaaggaatgttttgcttctgattatgtgattggtattagagtaagtgccatgtggtgatgagaagaatgaatgtgatatggtttggctgtgtccccatccaaatctcatcttgaattgtagttcccataatctccatgtgtcatgggagggacctagtaggaggtaattgaatcattggggtggttacccccatgctgctcttcttgtgatagtgagtaagttctcacgagatctcatggttttataaggggcttttcctccttttgctcaatgcttctccttgctgcaatgtgaagaaggacatgtttgcttccatttccatcatgattgtaagtttcctgaggcctcctcagccatgctgaactgtgagtcaattaaacctctttcctttttgaattacccagtttcaggtaattctttatagcagcatgaaaccagactaataaaaaatgttatgttgtttcttggtggggcgttccatagataaatatcaagtccatttgatacagggctgagtacagattctgaatatattttgttaattttctgcctcgatgatgtgtctagtattgtcagtggggtgttaaaatctctcactattattgtgtggaagtctaagtctctttgaaggtctctatgaatctgagtgcttctatgttgggtgcatatatatttaggatacttagatcttcatgttgaattgaaacctttaccattgtgtaatgcccttctttgtctttttttatctttattggttttatgtctgttttgttagaaactaggctagcaacttctgttttttttttctgtttttcctgtccttggaaagactggaattttcctccattttttattttgaacctatgtgtgtcttagcatgtgagatgggtctcttgaagacagcatggcaatggatcttggttctttatctagtttgtcattctgtgtcttttaattgggtcatttagcccatttacatttagtattattgttgtcatttgtggattagatcctgtcatcatgatgttagctggttattttgcagacttgtttatgtggttgcttcatagtgtcacttgtctgtgtacttcagtgtgcttttgtagtggctggtaatggtctttcctttcatatttagtgatttcttcaggagctcttgtaaggcagttctggtggtaacaaatttcttcagcatttgcttgcctgaaaaggatcttatttctcctttgattacgaaacttagtttggccagatataaaattctgggttggagattctttctttaagagcattgaattttagcgcccgattccttctggtttatagagcttcagcttagaggtccgctgttagtctgatgtacttccctttgtagatgacatggcctttctgtctggctgcctttaacattttttctttcattttgaccttggagaaccatgtggttatgtgtcttggtgatgatcttttcatagagtatcttactggggttctctgcattgcctgaatttgaatgctgtcccctctagctaggttgggggaaggtttcatggatgatattctgaaatatgttttctaagttggttccattctccccatctatttcaggtacaccagtcatatattcaatttcattacataatctcatatttctcagaggttttgttcattcattttcactattttttctttattcttgtgtgtctgtcttatttcagaaaggaagtcttgagctctgagattcattcttttgctttgtctattctgctattactacttgtggttgcactgtgaaattcttgtagtgtgtttttcagccctatccagtcaattacattcttctctatactggctattttgtctgttggcttctgcaatgtttctttttttattatttgaatgaatatttatttaaagtttccaaaatattaccaagacactgtgctaagctgaaggtggaatatgcaatataaaagcagacatagtccctgtcctcagggagcttaccatctcattggggaaacaatcagtagacaaataaagaaaaataaaattagtgtcttaatagatagcaaagtcaattctttaggaagaaatcatattcttctttaactttctttgtaatgagatatttatttagttatttatttaaattccaatagttttgaaggaacaggtggtgtttcagaaaggtagtgtttaagttctgagtttctttcctccactttgtcttttctgctattactacttgtgattgcattatgaaattcttgtagtgtgtttttcagctctatcaatcaggtcagttacatttttctctatcctgactattttgtctatcagctccagtaatattttatcatgatttttgtcttccttgcattgggttacaatgtactgctttaactcagtaaccttcattcctctccacattctgaattctacttctgtcatttcagccatctcagcctcagcatgttgtaaacacattctttaatccattatcccatgtaactgtaatatttgtttatggttgttagtgtttgttcatgagttttgcaatttgcattgcttaaattctttctatgcagtcaaaactaggtatctctttctgtattaaatttgacttaggtattaggcttaaaatccatttcccatccatttaaaaataaaaccattcatgaatatattctccttgtactttaatggtttaacatttaaattaaatttaataacttttcatcagattataaaaattgatatgtaatcattgtgaaaaattcaaacaacacagaaaattgtaataaagaaagtaaaaggagccaaaaatagtagcattaaaaatttttgatatgttgaaaatgtcttttcagatgtatccttagtcatatatacaccatgtctgaggatgcaggtgtgtgtgttgttctaaatgctctatgcacactgctattgacactccaaaatatgtcgtggtgcctttttatgtcaattaatacaaatatttttcattaccaccaacggttacatggtgcaccattttatggacttgttacaatacatttcattaaccatctgtttccagttttttattatttagacagttatttgataagatcatttgtttgcatatgtgtgtgcatgtatacctcacccaattgtcaggttaatccatttttatatatttctagactttgaatttttgacctaaaaagattgcaatttaaaatggttttacgtatatttctaaaagattgctataaatattgagaaatgtttacttctaacatctgcttaatctttacaaatttgatacttaaaaacttatacatctcattaaaaatatatctgaatgtcagagaagttagcacacatacacccaagtataacattttattaaatcctcaatttaattttccaagcataagaagtttttacctgaagtgaaatggcaacacaaggtaagaacagatgtagcatgttttgatgtattttttcttttggcgccatgcagttgcagttatactttctggacaaatttgcatcttgcttgatttgtgaagttccgcactttctttcccgctactcttttatactcagagctagtaattttattgtgaaagaacagagcaaagcagtgtatcctagaccatttcagggcatgtgtgcatggttttaaaactaaaattagtatcagaaaagctacattctcattcaggtggtggtaagggagggattgaataatttgaatgtgtcaatagaggatcctgatatcattaaacagtatctgcctctatctttccggtatttctagataaaaataaacaaagagagtattccatgaaaaaaaaacaacaaagatatgagaaaaatcatgaaacagtagagagaatattggtatctacgaaagttgtcatcccaacaaatatggttgtacacaaccaaatgctatggctctatgaacttcattgctgcagtggtataaaatataagccaagaagctttaagaaatgaggattagaaaagcttatgctctattttaaaagatttgactttattcaacatgtaacgggaaaccattagataattttaacccatgaagtaatacatgcatgtttgaatttcagaaaactccgatatttttgtggagactggattagagaagtactcacataaagaaaaagtagagagtgaagagtctgttgaaataacactggcaaaaattaatgtttgaatgaagaaaataaacttttaagaggcaaaattggtaggactttgtaaaagatgttataaataaagaagggaaaaagtgtcaaagattactggttcatatgctgaataggaaacatcggatttaatgcaagttttacttttatcaagaatatattataaaatggtaagttcaagagtattgaagatgtgtacaaacggtgattattatcattcaaagtcaaatttaagatagacaaggaggaaagaaaacatatcaaatacatgatagtcaaaagataaaaatatttatggtcctggtgggagcaaaggatgttggaattgtagttctagaggaactgagccagaaagataggaaatggcgatcagagggtgggttacttgccattgagattacctagcatttgcagttattggtagttattttcagatatgagtgggagtgagtggctgaagtgggatggaaggcataatcattggaagagagaaagttcaggaactgagaacccctggtgttgagataattttccatatgaatgttaaaatcgctgaggatcaagacaggaatagggactacagagcgcagagttgcacagaacatagttctgaattagcgaaaattctaatggtattaaaaactttaagaggtaatcatggtattgtttcttagagattcccagtgtgatcatacaacctatatcatcacttttaaaaatattcccagtccatagcctataataagggcaagtttacacatgcaccatataatgatatcaatccctcatcacaaacgaatggaatacagatggacacctgaccattatattctcatcagaccactcaaatactcttcactagaaactttaattggggtccagtgactgggtcagtcattagtaggaaatttagttcaagagtcatgtagagtcatgggctgaggctccaattctggggtatctctgattagtcatgtgtgtttgctgagagttaaggagaaaaggcttttctgagagagaagcaggagaatggagcagcaaacagacataaacacacacatacacacacacagaaaaattgtcttgattctaaattctcatgaggtcatgttacatttcctatcactaaattctgtaaattctcatgtatccttaccatacttctaatatttagctatgctattttgatgggattcctcctccatgcaatcagatttgctttatgagagcagctataatttactcattcattcaataagcattaaatgagcacttactaagggcctggactgttggaagcactatggaagataaaaacacgagcaaaatatggtttctgtcagtcagaaaattaatagtggagaaaacaaatataaaatataattaaaacacaatgtaatgagtgctaaactagagatgagcggtaaatattatgatctcattaggcaaaaatacaatatgttagctaatctgaaagatctggtagagtcagaaaaagccggtagagtcaggtcaaatgagacaaaatttaaaagtgtcttgagcaataagcacatatttgcaaagtgaagatgtttgaatgtctagatggagaagtgaaggtaacttagaacaagagctttgaataattccaagattcaagggtgtgttagtctgttttgccttggccataaagactattactggagactgggcaatttataaagagaaaagttttttttggctcaagattctgcaggctgtaggagcgtgacaccagcatctacttctggtgaagcctcaggaaacttataaccgtgaagaaaggcaaagggagagtaggcatgtcacatgatgaaaaaagagcaagagagagatgggggaggtctcagactctttttaacaagtatatctcacattcactcattacttcaggagggcgccaagccatttgccagggatcttcccccatggcatgacccaaattcctcccattagtccccacctcagacatttcaagatgggatttggaggggacaaacgtccaaactatattagagggttaggtagattggataagttagcaaaggaaatgtgaaagaaaaggcaaagggaagaaactaggggactgtgatgtcatacaaactcagggcaaagagtatttcaaggaggtagatgtcaattacattggacattactgtgacattaagaaatacaatttttgaaggtttacattacattggtgatactggtttccttagctggaggaagtaaacttagttggagaagtttcagtacagcagtgagagcaaaatctggttgaaacaccttagtagtatgtgggaagtaagggattggagagagttaatatggacaattaattttttaaaatggctttgaaggtcaacagagcagtagccgaagagagaagtaaaatcacaggataatttttttaaagatgtaaatatttgagtgcattaaaatggagctaaagattctatcatatgtcagtgggtagagaaagaataattaaatgatcttgtgacaattagtaaaaggttatagaaatagtaatgaaatgatgttgtgacaattagcaaaaggttatgcacagagatgttaagcttggctttatttacaacagcccagaaagaaatgagccttaatgtcacaaaatgtcccaaaataaatgacgaaaatcttgaagatttttcataggatttgggtaggttattatgaagaatttaaaaataatatttcacagtaacattaatgagaaaaattatagtggccaaaaattaatcaagtgaaaaataaaaagtacagtgtaatatataaagcatattaactatgattcttattttgccattcacatacgcacaaacactggacaaagactggaataaaagaaaagaaattgttaagcagctatctgggtagtaagattactggtgattttactttaaaaaaactcaacttttaactttcaataataagcatgtattatttttataatcagaaagaaacaagtattgttctatactagatgagttaagcatgttacatatttctctagtagacaaaaatcctatgcttctaagaatgagacttattttcccatcaatttattatatcattatcatcaccaccatctctcttcttaaaatttatctcctacctcacccagactgcataatccaaatatttaaaaactctgaacatgaactactaggcttttcaaaatgtatgtgtagtgtgtgcgtgcacgttcacatttaaatgatggcaaaaatgtgtttcagggtctttttttaactcaaacaatttcacacctactttaatttttcaatcctgcattcagaagctaatatatttagaataaattctaatgaagccatggaaactatttaatgttatgtcaattattggtgattgtgtgggcaacaatgcagcctgtgtggctgattggaaattatttctcttttataaaaaagaaatcttgaagggttccaacttgctacgattaacgatacaagtaagcttaatttataactccaataagagcaaagaaagatattttttcaatgtggactggaaaaactgtgaaaatcatgataccaagatgttaccttcccattgtattcttaaagatttcagtttcttatttttgaaataatttgaggtgaaaatacccagtattaacattgaaagtagtaagcttttctgaagtgtcttattgtttgcaagtctttaactgaacttagagcctcaatgtgaacactatcagggtcacgtgttgtccctagcaccatctggtcacacagagaagtcctttagaactactgtagccttgggattggaaacacatgctgtgttctacctgaaagtgttagctttcattgtgaattacccatacatatctctgaaatccaagatggttatttatggtgggtgactctgaaatgaaccagatcagcaatctaatatgacagcgtatctcccaatgaagatgatgacagcccaggattttctggatttatttagtatagaaatgagacagagagagagagaaagagagagaactcaggatggtctttcacaaaatagattaagaacaaactatttacttgattgtgctgtttgagtcaatcattgaatagaaagatcagaaaatttaaatttaaaaatcagcacattcataacacataaaccaaatgagttagggaaactgaaaagcccacctacttaacttctccctaatattctttaagagcatgaacattttcgcatttcaaagaaaaacaaagaaacgaaactagcaaaagacaatataaaattagtacttgaaaccattacaacagaataacaagtctaataaagatggcacaacaagtgtccagtttaactaaccacttgtgtcccaagcatatggaaatgactgataaactatcagaaggaaagacaaacaaaaacatagcaaattcaaaagcaatataatttctctctgaaccaaaaggacaacagagaaacacagtgttaaagtgggctgaaggtgcagctgcgctaggctgtttgtaagcggacaaatggaacaaggacttgtgctcctgtgtagtattaggaacttagcatcctctataaagacaggttaccaaagcaaagttctttgctagaaatcagaccctgaattatcacttcccatcttctttagctgggaaaatgtttgggaccatgaaattttaaagaactcaggaactaggaaattgaaaatataaagataggatctatgaccagaaatctttgttatccatttgatggccctgtgattttctcttgtttatgattaataaatggcatcgtaagaaaaactagagtctgcatggcacttaaggggtttggtggataaaattatacaaacaagcaacgggagtttattcaagataaattttctgtttgtgtgtgtgtgtgtgtgtgtgtgacagaaagagagagaggaagaaaatgagaaagaaaaaattctccctttaaagataagcctgtacatgagaattctaaaacataatgagaaatttcatgctaagaacttaggcaaacaaaataatcagtattacgaatatatatttattacaaattaaatcaatttaaagaaacaatatgtaaagactatgaaactgatacgtttaaacaaaggaaaattacaaatcaatatccacaatgtcattttctgccatttatctacaaagaccaataatactattttgaagaacaaagtatggggacttgtcctattatatatcaacatttatccaaaaatggcaattaagacagagtggtcttgttgaaatgattacaaacggacaagtagaacagacatcctagaaactggtatatttatgtgtgaaaactgaaaatatgaaatagatggcaattcaaatatgagggggaaagtataaatgataccggaaaattggttattcgtgtaaaaaaataaaattagattgtgcatcacagcagatcaaaactaaatccaggtggataaaagaactggatgtgaaaatcaaaattgcaacacttttagaatactatatagaaaactggctcaatgactacaagatgggaaagtatgcattacaaatgatgaaacaatgacagtatgaagaaaataattctatcactggcttaggttgtaataaaaaatatttggtaacattaccataaacgaagtggaatgaaaagtggaatcttggggaaattttatttgaaaaaatgaatagcttaaaaaagattaatatatagaattggtaaatagctacgaataaaaataatggttagtttatggatagtatacccataaaatgggaaactctgcagctgttaaataataaagcagatctatattttttgataaggaaatatatctatgaaatgttattaatgaaatcaagcaagatttagaacagtgtgtatagtatgctacctttgaatatgtgtatttgaaaagcacatacattttctgtactcagtaggttacaagatgcaacaggaacgaaactattcttaggaaaggaatttggctaaaaaataaaaggtaagacaataccaggggctagaaatggggtacttcatacactgccaatgtaaacttaaattgacataaacagggagcaatttcatagtttctaattaagttgaatatgtgcatgttgtttgatccattagtttcactctaaggcatacacctggaacagtggttctcagagtgagctggggacccttggggaggtccttgagatgcttgtagatggtcaggaaaggacaagttagatttatattattactaagatattatttgcctttttcaccatattgacttgtgtactaatggagtaaaatcaatgactaaaactgatagcacattaacatgaatcaagatggagtaacaaaacatactagtaaacatcttatttttcatgatcacatattcacagtggaaaataaaagacaagaagaaaaaagcaagttttatttaacaatatctttaacgaaacaaaaaaattagtaactgcactaaatcttaaaccttgagaatgtatctttaaaaaatattattggtgacaaaatgggaggtacacacaaagtacttctactttataccaaagtagataatgtcttaaggaaatgcacttctgtgattgagttccaaattgaactagctgcttttattcatggactgccattttaattgaaaagataaatgacaaaccattgttttctacttactagtttttccttctatttttagttgacatataatacttggatatatttttgggatactgagtggcactttgatacatgtatacaatgtgtaatgatcaaatcagggtaattaacattttcatcacttcaaacatttgtaatttctttgtggtgggacatttaaaatcctcttttctagctttttgaaaatacacaataaattactgttaaccatattgacactacagtgctatagagcactagaaattattcctcctatctagctgcaattttgtatcccttaaccaacctctcttttattcctcctcctcattaccctcccagtccctaataactactattttattatctatttttatgagctcagagctgtttttcaactccgacatgtgagtgaaaacatgtgctatttgtctttctgtgtctgtctcatttcatttagcacaatgtcctccaggcttaacccatgtggttgcaaataacaggatttcattcatttttatgcccaaatagtatttcattatgtatacatactggattttctttatgcattaacctgctgatggatattgcatatcttggctattgtaaatagtgcttcaatacacatgggggtgtgggtatccctttgatatatggattttttaaaaatgtatacccaatagtggaattgctggatcatgtggtagttttatttttagttttttgagaaacgtccatactgttttcaataatgacttaataatttacattcccaccaacagtatacgagggttatcttttttccacatattcaccagcctttgtggtttttttgtctttttgatgatagtaattttaactgggacgagatgatatctcattgtggtattaatttacgttcactaatgattagtgctgctgtacattttttcatatacctttggccacttgtatttttttgaaaaatatctattcagactctttgcctattttgtaatgagaattttgttttattttgttccataatgttgtgttttgttttttgtttgtttgtttgttttgcttttgagttgagttccttgtatactctggatatcagttccttgctggatatatagtttgtaaatatagtccctcattcttcagattgtctctttactctgttgattgtttcttttgctgtgcagaagctttttagcttaatgtagcctcatttgtctatttttgtttgtgttgcccaagcttttgaagtctttcctatagcatctttgcctacaataatgtcgtggagctttccctctatgttttcttctagtagttttacagtttcaggtcttacattaaagtattttatgtattttgagttgatttgtgttcattcttctgcatatgagtatccagttttcccatcatcgttggttgagtaagttgttctttttctaatatataatcttgaagcctcctccaaaagttagttggcttcaaatacatggatttatttctgggttctctgttttattcaattggtctatgttttctgtttcaatacgaatttcatggtgttttgtctactatagctttgtcaaactattgttatttagacaagcttttggcagacattttctgagaaatgaagggagtgtaccacttcaaggaaaacaaatgagagtgtttgttgccaatgatcttacttgaaaattcaagcaaaaatgggaatttttcaaaaatttttatctaccatgcaatcttgaccgtttcctaatacttaaagacttttctgatgagtttggcaatgaaatccataaatataactttttatattgtataaatgaaaagatctgcgtttggaaggtctacatactttagggaaccaccgttttctaaatcaccaattcaagatgttacaaattagtcatcagtaaaaatccaaagcacaagaaaaacaaatggagtttaacgtaaataagtatacaacttttcattgatttggtttcagattctacattgcaaataacctttaagaaactaccacctattgagttttggtgtaatatcaaagaatatccataattacccaaaaaggttattaagacactgctgtcttttcttacctcatttctgcctggggctggattttactgatatactgcaaagaagatgtttcactccagattggattaggaaaattcagatggcatttttttttttttttttggtcagaaatcaaagatattttccaaaatataaaatgatgtcacatttctcactacatgtcttattttataattataattatttttcctaagtgtcatttattttaatatgtaattggtttattattatatttaaattagttaaaacataaatatattaacactttttagttttaattcttaaaactaaatactgatacatataacccacataaacaaaagaaaggctctttgaggtccacaataatttttaagagtgtaaactggtcctgagaccaaaacattttagaactgctgctctagagaaaatattttcaattgttgtaaaatatacgtaacacaaaatttaccatcttatttcaagtttatagttcggtagtgttcagtatattcacattgttgtataacctacataaattcataaacaggaacacaaaaaaatgaaaaagatattcaatgaagcatcatttataacatcgtttataattgtatttagattgtttatgtgggaagcaatgtatctatcaagagaaaaaagttaattttatattaatatctataaattctattgtgtgtttatacaatgcaattatatttttccattgaaatgaacaaattaaatctacatatatcaacatcgagaaatttcaaaattataatgccatgcaagaaagcaagctactgaataaagtgtataggtgaatataatttatcaaaatatgtaatgtatgtaaagcttgaaaatatgcaaacagtgttgaatattgattattgacacatacacaggaagtagtaatatatagatgtgtgtaggaatgatttatacttattcagaaaaatgattacttctggaagggcatggagggagatgaattcaggcagggccacactggggctttaactgtatctataatatcttttccaaaaaagaaaagtagaaaataactgaatataattaaccaatgttaattaaccaaaattaaccactctgtcacccaggctggagtgcagtggtgcaatcatggctcactgcagcctcaacctctcgagttcaaccaatcctcccacctcagcctactgagcacctgagaccactggcacccgccagcacggcggttttttaatttttatttttttgtagagacaggatctctcaatgttgcccaggctggtctggaactcctggcctcaagaaatcctcctgccttggcctcctaaagtgctagaattataggcatgaaccactgtgcccagctagaattttccaaagatggaaagctgggtagtagtaaaaatatgttctccatgtatccaaaatactattctatatatccccagtgagagagattgacagcaaataaaagtatcctcctttccttcattcagttgacaaatattccttgagcacaggggatacaattgtgagctaaaatgcatttcctgatctcaaggggctgacattccaacagaacaacctatatagacccaggcattgttcttatgttaatgtatttaaagatgatctttattttgagaggaatgggaagtagttttaaatggttttgaatttcatcagactcttttgatcactgggctgaattgtcgccctgggactgagtccctaccttttccttatcacacaattaaataaaaaggtagagacattaattcatcagatatttattgagtgcttgctatgttccgcacgctgttctatgtaaatatagatacagcagtgaacaagacaaagttcctctcttaatggagcttgtaatcaagtttgacatcatataaaattcaactatgcatttatttattcaataaatatttattgaataatcattatgtgccagatactgttttagaaactgagaatctaagagtgaacaagacagactaagttttttttttcttttctttaggatatttccctcaaggggagacatacaataaaaagacaccaaaaaatagatacttggtaaacaagtatacaaggtaacatatagtcgtaagtattatgaagataacagaacagggtgatggttgtgagattgatgggtaagagttgagaaaccctttctaatgagatattttcacagcaataggaaatgcatgagcaaatgagccgtggatttctggcagagaagaggaaatgcaaatgcttctaggaggagcatgcttagtgcatttgaggagcagcatggaagccagtgtgactgtcactgagtaaccaagcagagcgcttggagctcagatcagtgtggtaggaaagagctagatcatggaggagactgtctcaaagaagaatatctctgtaaatgtctgtgacacagttgtatgctataaatattgcaatgaactttcttcatttagccattcaaaggcccttgcccctgaccttttggtcacattgagtggttaatggggttataatcccagaaagtgaaagtagaatggggtaaaaaattcctctttggttgggctttcactcttagacactgttacagtaaatgagagagagccaggacacaagaggtgcactcagctccataggccaggtcaccacacaacctggaagagagttcaaccctgatatttgtttataatcacctagttgcacaaaatgtaaacctgtccatgaccattagctcctccctgtgcctcaaataatggggttaaaagaatggactcagaactagagtgtctatactattagtgagaggaggggccagctggacttcctgggtcaagtaggggctcagaaagctgtgaaactcactcatttcctgcatcagggcttccttcggtcctggatggataatattgaagatatatgcttaaaatattcctaacaccaggatttgtgcatgtgttttcttccccaagaaagctataaacactgaaaattttgctctaagtttccctgtgtcctttctccctctctcccttccccctcctccgagactaaagtaaaaggaatattaactgcccgtttttctgtgaccagcagaccttatctatgctcccaattccaattccttgtaaacatactttgtaaagtcctgtgagatcttgtcttttttgccatgccactgaaaggtcataaaatagatgaaacctaagttgcaattccggttttcctcaagatctaaaacatgtcacaagtggttaattgtctgtgtttctcgctctggtaacatcttcccactgcacgtatttcctgccttaaagagtttaaaaggcaatcgtataatctaactctggctacccgttcgggaccccttccacactgtggaagctttgttgtgtcactctgctcaataaagcctacagctttttctctctctcggtccttgtctccatcactcgccgcggtccgccaccacaccaattctttggcgtggctaggcaagaaccttaagcgttacattaggttggtgcaaaagtaattgtggttttttcctgttaaaggtaatggattaataggattctgaattcatctttctgagctgtgtggcattagacaaatggcttcatttctctacagctcattctccttactgataaaatggggctaataatcaaatgtttgccatagggctgctgtgagagttaaatgtaataattcatgtaaaatcttagactcatacatgccccatagtgttttaaaatactggccatcatcatcgttattgatattattatattttaatgacaattattgtgtgctttttttttttttgtggagatggagtttttctcttgttgcccaggctagagtgcaatggcacaatctcggctcaccgcaaactccgcctcctgggttcaaattattcgcctgcgtcagcctccccggtagctgggatttcaggcgtgtgccaccacaccctgctaattttgtatttttagtagagacggggtttctccatgttggtcaggctggtctcgaactcccgacctcaggtgatccacccgccttagcctcccaaagtgctgggattacatgtgtgagccaccgcacccggtggcaattattgttaacccaatatccattagattaattcatctttcatgtgatgtatgaatttcctaaatctgcttgttgggtatctgccctcaactttattcaattcctgacattccagctaatgtggtctttttaaagctttatgataatgtacatgctcttgcttaaaagccatgttttcacagggagtggtggcttatgcctgtaatcccagaactttgagaggccaaggtgggcagattgcctgagtccaggagttcaagaccagcctggaaaatatggcgaaacctcttctctactaaaaacacaaaacattagctggatgtggtggcatgtgcctgtaatctcagctactcaggaggctgaggtgggagaatcacctgagcccagtaggtctagactgtagtaagcagagactgcaccactgcacttttagcctgggcaaccagagtgagactgtctgaaaaaaaaaaagaaaataaaaaaagcaatgtctccactgcccttatgatataaagatcaacttcttaacatgactttcaatgtgtgtcatgatctgttcgtggttttctaatttcacttctcatcactattttccttggatggttagtgtcagcctctcttaactgtgttcaatattctaggtgcatgatgctcatctgtcttggcctagagaagttgttcttaaactatgatctatggaccagccacatcactatcagcaccaccaaggaactcataagaaatgcaaattattaggctccacccccaacctattgaatcagaaattatgggggcgggttctggtatatgttctttacgaaaaccagcagatgattctgttgcacaatcaagtttgagaactgctggcctagatatctttttccaaggtcctcaagattttgcttgaagaacgtacaagaaattttcaagatttatcgtagatcttacctcttactctctaagaaagctccttgcattcaccttccattttatttgttcatctttccctttagactatgatggtttggaaagcatagaagtgtcttcataaaatttgcatacccaaaatatagcatagtaccttaatgtatcatatgtggttcaataaattatgtagcaataagtgaaagaataaataaataaatgaacagatagtatgagaaaatattatcttaacagtgggcactattagggagagaaccatgtttaggaaaatgttttcacatgccacttatgggtcaaaagtgacatcctgaaggcatgaattacaagggaatggaaaaaacagttaaattgctctgcataagaggtgaacaagaatatctgaagttggataaataaaggatgagataaccaaaagagagaggttagcaaatatgacagaaagatgaagaattttagagaaaagttttgagtgagaaaagtccagtgaggctttgaagaatagatacatagaatgttcatgtctgggtttgtgatattgcaataagagatgtcctctgttggtcatcaagtatacattaaagtataatgaggctgtattcaacatagcttgtgtggccatgttgcggagattactgtggcacaccatacaagaaactatgtgctgccctacagtaacctctctgtgatgtctctagagataacctaattgtcaggaagaaggcagtggtccagaagtcccaggcagtggagccgaggaaggtgcaagaagctgcttccacctgaaaataattcaatcatagatatatcttttttcttgttattcttgtcattgttgctgctgcatctctcaaatatactagatgggggccatcttagtaggtggaggacaggtaatatcagtgttacatatttgataactttaaattatattcacaaattctctgataggcttcctttcaagaagtgaagctgaactcattttcagtatgagctagacttagtgacttgcttccagcaatgagaatatggtggaagtgatgagatgtcacttccagtgggtacagaaggactgtgacttccttcttgctgttctccagcaccccctcacaatcaactctcttcctttgccctctatccagtatccagtgaggaactgaggccacataagtgggcttggaaatgagtcccttaaccccagtgatgccttcagatgattgaagcactgaccagcagcttgacttgcaagatcatgagagactctgagctgtaaccactcagctaagtagcttttggatttctgacccatagaaacagtgatgtagcaagcatttgttttttaagcttcaaagatgtaaataatgtgttacacagcaatagataacggatacccatatggttatcctatcttatgaggaataaactgaaatctcaagaggtcaatgggtttgtcccatgaacaaaaagctataaattcttagagctgccattcaaaccctagccttgtaactcctaattcattagtcctaccattatatcagactgccatcagtcatgtgtaacttatttattatattcccaaacctagaatataattctaagggcattattaaatcttaatcagaaatatcaaaatatgaaggtccatggtttaatcattgtctttgtatatcctaaccaagaacatgcgtaccaactccaaaactgcaaaaactaattattagaacaagaaagtagcaagggactttcgagatatctgtaataaagtttcactatgtagacagagagaacccctgagagaggaaattactggaaaatgccacagcttgagtaagagatggaacaaagactcacctcaactgtacaaagaaaacgtttttgaaatttagttttaatgtagttagttccttgaggacagagacttacaagttgatgtgctcaaagcttggcacaatggctggaacagaatgtcaagacactcttttgagacagagtctcgccctgtaccctggctggagtgcaatggtgcgatcttggctcactgaaacctccgcctccaagcgagtctcctgcttcagcctcccaagtagctgggattacagatgtgtgccaccacacctggctaacttttgtatctttagtagagatggggtttcaccatgttggccaggctggtctcaaactcctgactttgtgatccgcccgcctcagcctcccaaagttctgggattacaggcacgagccaccgcaccaggcccaaaacactcttatctagcctcttgctagattaataatgcactctattacttctgtaaaatatagtgatgaatgctctaaggcatactgaaaactcacagctaattgcctacccacttgtatacatctgcttccacctgttgagttgtatgctcaccaacagcctttatgttcatttccaaatcactttatgccaaatgtacaaattattataataacttgatttgattgaaaattatagaaactaattaaatataagtttaaaatgagaagtattctttttatgaaacctcaaactattggaaaagatttgataaaggaaatttgttaattaaaaaatttttactatttttaattttttttatacaattagatatgggagagagtttagaaaaaataaaacaaaaatctagaagcattctgcttaaggggtgtcctcaagtttctgctacatttcatagaaggtgaaacttaatattagagatgatgccttatcatgtggtttacaatgataagcttagtcaaaggacccacacacatttaaaaggccatgagaaagaaaaatgaggccaacacagagaaacataaatgtttgtttatattatgtaaaatacatacgttatctaagataagtatatgtaatttgtaaatgattttcagcttcagccaatgttttcaattaatcaactaagtattggtcacaattagataataaggcttctgctgtaatgtatatgaagtgtgtaataaatgaattaatgccaactctgatgaagtagataaaacaaggcaccctacagatgtaaggcatttttcagtttatttggaaacttgtcaatactcatctaatttacaccgaaatttcaaccttgtttttcatcgttgtgtaattagaagacatctgaacaaaaataaagaacttccaagtctttgtttgtttcatgttgcacttatctccctccttggcagggtaggtttctttctttgggtgttttgtgaaatttatcccttggcagctctagttgattggcttacatactgggtgagagtttgtaagcagagtagtgtttccagtgccatctacaatgtgatggtggtttctgacaagagtttccagtgctgctaagcaaccattactgatggctaaaaatagggaacaactatcatatttatgggactctgaaagcttaaggagcttttacaagccaattgctttggtacataattactataagattcagcttttgaaacggattaaaatatattgtgtgtgaatctgcaataattttctacagccaaaactgttcctcagattaaaggctttgtttgcattgatttcttttctatttaaaaatattaatcgtacttcatctgggtagacattttcttcccgtgtccttatttccctgaattaaagagatgcaataatatataaacaatacaaatatggagggtagatttgaaacttccttctgaaggaactgttgatttcttcacacttgtgtctttatatattaccattttatcatgaatccgtttacctctgcattatttcatatttgcattcattaacattaattacttatagttaccattttttatctctttatcaaccatccctcttttcatctgtgcatttatttattgacctagctgccctgcaagcgtccatcttcatcaactctttatctatttgtctagtatcatataatgtcttctctttattttgaagttgtacttaaaaccattgcaaaacttgcatcactatccctttctgactccttacatataaaaaaatgacttgtagcacctaacacgccccacaaataacacatctaatttcaagctccatgagggcagaggacatatatctctttgtgctcacattgtgtctccaatcctagtacagtgagtgactggcctttaatagttgcccaatacatattcattaaatgaatgcataaatatctcccatgtgtttatatccttatccatttctcactctttttgaccatcgctccatcagtttctttctcatcatcatccttttattacctactttcacttctacaagcctgtctgtcaggtttttcactcatcatcccaactattcatctatccatttctatacctaaagctccctatctgtatctaagcagctatctaacattttgttaatatattacaagatatttttatttgttcataattgcatctatgcctctttcatctccttgtcattcattaatccatcattctccaccatgcttttaacctaagttatattgcgtatcgttttaatatcgaatgataaggtctgcacagtttccagtgaaaggtccaaaggaaggatgacagagagtttgcacctttctccatttattttatacgaattcaattatacaaattcagcaaataaaaataaaaaagaagagaaaaaaacagcaacttaagtagtgcctgtcacttcatttaatgaatgtagccaataaatgaaacatgatatatcgattcctaaagtcctcctaatgagattacaaagtttaagaacacgtattcatacaaaacgcccttgcaacacaagccgactatttttttgtgtagctcacccagaaaaacagcaatttgttccaaatttttagttaaaaatagctatgtcggttctgctaaccaacagtagtatgcttaagaccacactcctatctctacacattcaaagtcacagccacctaactgcatatagtagaatatttttagccatttcaaatattttagctatttcaaatggctttttcttttttataagccacaattgattttaccatctcaaatttttctgagctaacaatcattttaatcattttatctagtctctcagtttctttcataatgcagaatcttccattctggatcccctgtcctcacactgtcagctggactgttctgtaggactcttaaatggctgcaatgctgaaatttcccttattgctttattggattctatgtcttcatcttcctggctttgcatttttcctagaggatattctcaaaaaacatcttgaaatacatgaaatgagcgaaatgaacatgttcaagaccttcctgcttgaaacttttttttttttttttttttttttttgtttgagacggagtctcgctctgtcgtctgtcgcccaggctggagtgcagtggcgcgatctcggctcactgcaagctccgcctcctgggttcacgccattctcctgcctcagcctcccgagtagctgggactacaggcgccccgccacaatgcccggctaattttctgtatttttagtagagacagggtttcaccatgttagccaggatggtctcgatctcctgacctcgtgatccacccccccacagcctcccaaagtgctgggattacaggcatgagccaccgcgcccggccgaaaagttctttattttcacctttacatttgatagtttagggagcaaaaactttctcacatccgtgcattttcttctcaaagtttgaagcatttcttcattggtttctcgcattcagcataattgatgaaaagtttgatgtcagaactacacattcttttgtacgtaactgactgcttatcaacaactccagtcctagctcccaggaacactttgtttttgtattttctttgctgttataaaattttacaattatatagaaaagaaaggttatcaattttcatttattgttctgggtattttgatatgaaaagttgtgtcctctttgggaaagtctcttctattatttactgaatatgttttactcatagattctgtattctccctttatagaatgcccaataatcatatattaaaactacgaaacaaagactaattttatatttttccacatttttaatcttttttatgagatttatttaaatttaatttcaagtttttatattaaaaattttgttggtgattttaaatttcaaagacatttttctttttccatagttgtgtgtttcttcctcctttttttttttggattcactctctggaaacttactatagtttttttattcttttaattttgtttctttcgtctggactgatttgctttttgttttttcttattttctttctgtacatgtttttcttagatgtgtggtgatatttctttgttcatattttagaatgaagcagcaaaaacctactagagactgttgtttacatggttggagatttcaaatgatgggttttagtttatcataaaaaagagtagaagcttgaatgtatgttctggaactactaaattgcagaacacccattaatttgctatgagccgaaaatatccaaacaataacctctgttttctttaactaattttatttctctagtgaataattttaattttttttcaagcagttaaatacattactactaggattgttccacttctggtgttacaaggtgagaatcttcttagacctgtgacccagtgaaattgttgaaaattatacatatattttatatatatgttgtatttattatatatgtacgtgtgtgtgcacgcacgtgcgtgtgtgtctacatttaagtctcaggaaatggtactaaatgtatatagcaaattaagaaacctttattccaaaaatctattaaaattcttcaagaacagtgagagtctgtggttattgaaccaagaaccattctctttttcctctgtcagagctcagtgagccagaaactccattccagactgatgcagccaaaaatggaggaattcttctgcctccagcttttagtcacgggactaccctcccaggaagcatgggcaggatgttgacattcctcatccagtccccagctacctgttgctaaattctgggtgagtgaaactaagaaataggagcttcctttttcttcccagctcacgcttgtgagactaaggctctaccttgggtgaaacactgccaagaatattgcgtcactgattagccttttcctctcttgcaggatggcaacttcatgctgggagaggcaagcagaagatctgagtcttctcctggaactgagcacccagtcttaaactgggagtgtcgctcagggataagtgtgacgttgtccccattttcaactccaaagccatggctcaaggatttttcttgggaagaggaggctataaacagagtgctccaaatatcgtcccaaagaaattgatttaatttgcaacagagtgtggaaaagttcaaatctaaaagtgttactgtggactgaatttagtcccacccaaatttacaagatgaagctctaacccccaacgtgatggcacttggagatggagcctttgagagatacttaggtttagacaaggtcactgggggggggctctcattatgagatttataagaagagacacaggagcttatctgctttctctctctctctctctttctgccagccacatgaagacacagcaaaaaagcaatcatctccaagccagaaagagaacctttccagaaacgtatcatgctggcctcttgacattatatataacagaaatgtattgcacagttttggtgactgggaagtccaagatagaggcacaggcagatttgttctctggtgaagacccacttcctggttcatagatggcagttctatgccgtaccttcgtataatggatgtggacaaaagaactcttgggacctcttttataaagtcattcatcccattcatgaagattccactctcatgacctaatcacatcccataggccccagctcttaataacatcacattggatattggattttaacatatgaattttgggggggagtcacaaccattgtctatagcaccaacttcagataattgttaaaaatcacttcttcattgtggttttcttccccttgtgtttattgttgtgcatttttgtcatttaggaggctataaaaacagcttgtttgctggagctttgcacatcattgcttcattcaaaagagaatctcagaaaattactgtgatgtctataatctaacaaagagaatcatggatgcactaagtatatactgtgaatttaactcagatgctcatgaacaaatggtttctttatacttgtatatcagctcctctatattaaagatgtagctaattaaacatatgtttattttttatgattattttagacatttttcttcttgagttttgcttgttctttgttgctaaccaaattgtttgaaaattcttaggaaaattacttatacctacaaattacgtatgatgtctaatttaaactctaaacagactctatttctcatgttacatagtggagaaggtataactccatatggttaattgttattttgaacctgaagtcttaa

SEQ ID NO: 1203 - DNA, 907813 bp, Homo sapiens
actataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcctatgcttccagggggaatgattcacaacctgggaaacctagactttacacactggcttttcttcttgttttaaggtagagagaaattcttaattgtaatgtggtcaagtgtgtcagccttttgtcgcttggtttgtgctttttgagtcttccccaagaagtccctccttctcaccatgaggtcataaaggtgttctctcgtgactggaaattttcacgtttccacttaggtccttgagccatctggaatttgtgtctgatttggtgcaatccagctctcctacagcctggctgggagacttggagcaagtcgggctccctgagtccccagctaacagatgagaagattaattaggccatctctgtggcatcttcatcacctacagttgcaaacattcagtcttccttgctgcagcctgtgaccagggtgatagtccagtcagcgtgataataaaataatcccgccgacttccatgctgcaaaaatgcagccacgctgacatagcattggctgtcctccccagctctcttccagaaacaaaacaaagcacctcaaagcaggtttcccaaggcccactcacggccagaactttgctttaaatcattccccttcgacagtttagttttaactatactgtatgtacccaagccaaggatgggaggagaagcctcagtaactagaattgttattaaaaccatatatccaactccactggcttttctggaaacctctacctaaaggacgtttaagtcgtctattaaaatatttcagacttgccctgaaggaggcaccaagaagtgccacaactttgcaggctagtgaccacacagatggaaatgtgtctctggaagcaagtggctggtgttagaaacacacacacacacacacacacatacacacacacactcccacaaataaaaatctagtcttccgtgttcactcgaattattgtaataatcactgaggatgtgagactctgtatttagtcagttctctaagtatgacccagcccagccgtaagaaaacatgggagggatgggtgaagaccccacagaggagggagagcctgactgaggggagccagccttcacaggggtcccggtggggatgcaggcaagaaactcagcccaagctcatctaaggtggaaggtatgcgtctgatcaagatacaggggcagggaggggtggtgtcctacaattctcaagggcctgagaaggaggccaggagcaaagttgtctgcccatcaggtccccaggtcctaccaaggcagagaccagctggtctctctgtcccagtagaaaattcctctggagagagaatctgattggcttgagatctgtgattaattttatgtgtcaacttaactgggccacaaagtccccagatatttggttaaacattattctaaataggaggctgggtacggtggctcacgcctgtcatcccaggactttgggaggccgagatgggcagaccacaaggtcaagagtttgagaccagcctggccaacatggtgaaaccctgtctctactaaaaatacaagaattagctgggtatggtggcgggtgcctgtaatcccagctactagggaggctgaggcaggagaattgcttgaactcgggaggcagagattgcagtgagccgagattgtgccactgcactccagcctgggtgacagagcaagactccatctcaataattaattaattaattaattaattaattaataggggttttctggatgagattaccatttagatcaatagactgggtcaagcagattgctactgtggtgggcctcatccgatcagtagagtcttgggtagaacaaaaaggctgaccttctgagggcaagagggaactccccctgcctgagtacctttgaacagggacactggttcttcctgggttgggagcctgctggccttggaacaggagctacaccattgggccttctgggctcaggcctttggactccaacaaaggcctgtgtgagaaatgatgtcgagaactggtcagttctcctgggtctccagctcgctggctgcaggtcttggaacttgtcagcctctgtaatcacatgagccaattaatgcacatcctactcttctctcggctctgtttctctgggggaccctgactaatccaaggtcccacagaacacaggtgactcctcgaggctcatctctgtggatgggagaggcagttcccagacaagggaacatcatgagtggggcagacacccacagaggcctacagtggccacttcactccaggagccgcacacctagctgcaggaacccgagccccagtgactagcgctcatgggaagggcctgcatcccagatatgtgatgacagcccatcccaaaggccagctcagaaaatgctaggatttgccttcacccccagtggggtcatgtgtatgaggggggcaagtgggaagggagactttggaccccaggccctgcccatcagccaccccatggctgaggggtcacccccataagctcttgaatgccagcacaaggcagtctggggaaacttggtgacgtggacagagcccctccttcagggaagtttctagactgggctgtgtgcttggagccactgtgctgggcacagcctcccccagttgaccatgggctctccaccatgtgctcctgccttagaatcagcctccttctctgtaagtggagatggccctggcggcccaggtatgagaggccccaatcaatggcacttctcccatccacctctgagctagcggggaaataagacacaagagtgaggcaggaaaagaccaaagcagcaacagccagggcctcttcccagtccccagggagcccctcggcccctacccactttcaaggccagcgatataataagtttgtttttgttttccaaataaaggtttatttctttctgcttaactctttttcaaaaaatttgattttattgtgctaagaacacttaccgtgcaatctcccctcttagctggtttctaggggcacaatacagtcttgttaactctaggcaggtgccatgcttcatggccggtccccagggcttattcatctcactgcactgaaacttgaggctctttgagcagcagctcttcagtcccctcccccagcccctggcaggaccatgctcctgtctgtttctgcgagtttcactattttatatacggcacgttagtggaatcaaacagtgttttgtgtctgccttcttcacttagcatcatgtcctccagattgatcaatgttgcagcatgtgtcagagtttccttccttttttttgaggctgaataatattccattattccattgcgtgaatacaacacattttctttatccattcatctgtcggtggacatttaggttgcttccacttcttggctattgtaaataggcttctaggagcataaggatgctgactgttttggataaatacccagaaatggggttgctggatcatatggtagtcctctttttaatttgtgatacgtttcatctctcactctggcgatgtctgagcttctcccttgatagaggtagaaagttccagagaggcacaggcaggcccgcagtgagaaggcctgagcctccttaccagggtatttctcccccacgggctgcctctcgctaactgcacagctcaatcacacgtcccttcccagggctgctgtgtgtcacacgctcacacccacactcgctccatctgtgctgggtcgaagagtgaccctgtatccacatccatccaggacctcagagtgtgaccctacttggaaatagggtctttgcgggtgtaactcattaagatgaggtcatactcttcatgttggatggtcatagtacatcaatgcctgttgttcttatgaaaggagaaaacagcagggccaggtagctcatacctgcaaccccagcaacttgggaggctgaggtgggaggcttgcttgaggtcaagaatgtgagaccagcctgggaaacatagcaagactccatctctaaaacaattttaaaaattaaaaaattagctggtggcacatgcgtataatcccagctactggggaggctgaggcaggaggattgctggagcccagctggagctgcagtgagtcgtgatcacactgctgccctctagcctgggccacagagcaagaccacgtctctacaaataaataaataaataaatgttttaaaaagagagccagggtctctctcttctctctctctctctctttctctctctctctctctctctctctctctctctctcacacacacacacacacacacacacacacacacacacacacacacacacacacgagggaatgtggtatggagacagaggcagagattggagtgactcagcccctccaaagagtgccaggaattgcaggcaaccaccagattcaggaggaggcaagtaaggacccgcccctgcaagtttcagtgggaccatgaccctgcccccacctcgatcttgcacttggagcctccatagctgagacagagtaaattgctgttgttgttagccactcagttggtgggcatttgttactgcagtcctgggaaacaaatgagccgtccactcactcatatacagcctacttctattttactggtgctttctgctaactcctctcctttccatctacatatttcctccttccagatctccctcacctccctcaagaggggctctgtggccaggaaacttttaatgagatctggaaaaagtgttacttgcacattaaatccattattttatgaatatcatggcttaagacaagctgaagtttaaaagtgagtgatttcaagttgatcagaagaaaaatatcaagtaaatggggtgcatggtgacacatgagttgctgaaatttggggagcactggaatgcaagaaacagcactgattcagggtctgtctgtaattctgggtccaaattctgctttccctactggcactgggacacacaggcattgttgaagtgctggaccccagatttctcttctgtaaaatggaatcacagggtctaaattggaggctttctctgaaggatgagaataaagttagaatgagaatgttcctagcatggtgcctggcatgagcagattctcagcagatgggccctcctgtaatccgctgagggctctcctgcagtgccagcagggatcctagtcattgtccccaccactcctgtctgtcttcacccagaaccttgtctggatcctgggaggaagcaaacatctcctggtgggaatgtgaggccctgccaggttgtaggagtaactggaaaagggcaggtggccctgcccactatgtgggcacctcatgataaatgatggctctcattagccctaactcctcaggcaccttcctacctggcaccattatgctgggactaccctctcactctgggagcttcacgataaacccatcttggcttaccctggacgcctgtcagctcctggcagggtgcaggccagagggataccttttgcatcatgagattgtgcaacttgggaggctgaggcgggaggcttggttgaggccaggagtgttctggcaagttcacggaaagttctggcaagtaggcaggccagcctcttgcttagacagtgctaaaaggattctttttcactatctgccagtaaggaaagtggccatcttgttcagaggacggagtgcagcatccacatacctaccagcatgaacttggtgagcagaggccacctgcatcccagagccacagggtccctggagctattggcttcttgcctggatacttccaggattcccagtttctggaagctctggttgcagtgtgccctggttctgtggcacccagcaggtctgcaagggcagccagtgggtgtgagtctggagagtgaacatccctatgagaactgactcgtgaccctgagtttatcaccaaggggcctctgcagagacaggtcctcaaattaagagccaggcaaacctgtagagagagaggctctgggggtagactgggaggagtggaggatggtcaactgtccccacgcacttcacgaggattctccacctcccatgtcccctggcatggggagtgcaagataacaaaaaaaaaaaaaaagagaaggcagtgagcaggacccactcttcctgcagcttcttcacactcttcctacagccccagctgggccacctgcaccagtctgtctgcatctggggttggggtaggtgggttctggctggtttatggagagcctgctcctccatgaggtccatatctgttatttttccgcggcatcagcataagaggtttctggttttatgtatgtattttctggctctggctcctggtctgcatttgtatgcacaagaaggcataagagagatagagcactggatttccagagacatgtgtctggcagcattcgggaaaataacattatagcctaggaatcccatcacacatatgtgcacacatgcccacatgcaggatcatggtatgttggtggtggtgcagtttgtgcccatgaaggaaattgaaaacacttgttggagagaaaacccagtcgctggcatactattcccatcacagaagaggcagagcctatgattggtgcctcactgaatcacaggaagtgttttattttatccccacatcatgatggagggccacagctgccagctatgtctatttcttatgcacaatatagaccacaagagagaataaaacaacctcaaaactacagtgtggaaaaaaacctgtcagctagaaagggggagaaggtatctccaggagccaagaaaatctcttcaaggaaaaataaaaaaagtaacccactttactttttccccaaactgacaaatttgacttgtcagatgtaagtttaacttgtggacaatccactcaagactgataatcgccatagtaactgctgtgtcacatgatcacacagaagcctagagacggggaaagtggctttccaggccacttttcttctggtaaattctgtgatgtcagcctaattagcaggagtggaatcaggaccttggttgaagtaattggcagcccttctttaaaaagaacaaaggtattttagcaccttctcttcctgtttatgggggcctgtgccaggaccaacagggctctggtgcggagtcttcctcacccttcttcctaactggccaagctccaagcagtgcctctaaatgtgattctttgtagagccatgtctggagaaaaactcgaatttatctcctgaagttttcaaaatatcagaaactggtgagagagggggccgggaatacatttcagggctatcccgtttctttttaattagtattgtacatttcaacttctttcatttccaactgcttctccctgcaaaataaaggtatcatgtctttaaagctctccgtccatgacaacattttgttcttatactagaaaatgccattcccttcccaaggcacatctcttttagttgggtttaatttgagatgcctcttgcctgctaaaaacattggtgacttgccccagcaaggaggtgacagggccacttgtccatgttggccccctccagtgggactgagtggccaccacccccagtggctgcctttcacaggaagagaactgccttcttcaccgccgggcatcggcctgtggaaatctgtgcccagacagctcaggtggcagcttatccaagtccccagcactctgctttgtctgccccaggacaattgccccattgtcttcaggctaatgaagtttctggtcaaaacacaatgatttcaaacatctcttgagcctctctgccctccatctggaacagatgagtacatcaatcccttcaaacctgcctcctccaagtgcattctgcagagttagtgtgtgggggtgcattttaatcaaccacgttggccaatgctgcctacctggagtgaccccaacccccaactaaactgtgagctgtggaaatgaacagaagccagccaaatgaggagcaaaggctatttattcagagcttgtgctagcgagggagtcagccaccatcccttgtgttttggcagaaactcagaggcaggtaggggagtgggaaagcctcaaagaagaaagaaaggaagccttcgggttgccctgagtggagggtgttggcctggggaaaatgaaggtggctataagaaatgagactcccatgtgattggttagggagcatgtttggctttctttcattggtcctaagttggaagtggggacaaaaacctagggaatcaggctgggcatggtggctcatgcctgtaatcccagcactttgggaggctgaagtgggcagatcacttgaggtcaggagtttgagaccagcctggccaacatgttgaaaccccgtctctactaaatatacaaaaagttagctgggcatggtggtgtgcacctgtaatcccagctactcaggatactgaggtggcagaatcgctcgaacccgggaggcggaggttgcagtgagctgagatcatgctgctgcactccagcctgggggacagagcaagactccatctcaaaacaaaaacaaaacaaaacaaaaaaacctaaggaatcggtcagttattaatcgagtcctagaattttggggctgattgctataggagctgttgtttggcttctgggatgattgctacagattgtgggtcagagtcctgtctttctatatggtcttgacattgtctgtatattgactctctcagtgtgtacaggctgtcttctcccagcctgcttaaaattaatgagagtttgaacagacgagtgtgtggagggcacatcatcattagtacaaatagccacagatggaaattctgcatgcctttgacagaactgagtttgagaggctctacctcaacagcttcctcagcccagctgaagtctctctccctgaaggcccatgcacctttctcagccattgctgggaattcaggattgtgtgttggaggccaacattgggtaccatgagtggaaaccatgaactggggcaagtcctcctggtacacacacccagctactttttccttcctcttctgccccatcccagggaaccctctttgtaccatcccacccactggccaaacttcagggtcttgtcttcatacttactgcttttttctaagggaaaagttattgagaaggcagtcaaggttcatttatttttaaccaggagacagtgcccccaaacaagaactgagtccctagttatggaatgtcagacacctcgcagcaggtggtggttctgaaacacccggatccagatggcagccaactccacccacatgtcaggcgggcgacagcatttccggacatattccttgtttagatgaggagattctgcccccagtaacattccttcaagcagcaaaatgatgctagatctttccagaggtcacagactgaaggcttgggggctacagtctggaatgtgttttgcttggcacacatgcattttaagttgtttaatgacctatcaagatttaaagatcaggagctgacctttcatgttaaaaagaaaatctatattttccaacttgtcttggaaaatgggatgctctggcaacacttggccatcttcccaccttcagatgctcagcagaatggcagctgccctgtggagaggaagcacctgttcccttccttgccactctccctggctggcctgcagttttctcctgtgtgtcacagttatggactgactgcttgtgtcctgccaaattcatatgttgaaatcctaacccccaaggtgatcatattaggagatgaggcctttgggaagtgatgaggtcacgagggtggagccctcatgaatgggattagcgcccttatgaaagagaccccagagagctctctcactgtctttccaccatgcatgaaaatgagatgttaaagtcttcaacctggaagagggtccctgccagaatccggccatgctgggacctgatcttggacttttgagaactgtgagaagtaattttcagttgtttacaagtcatcccatcaatggtattccactatggcagtccaaactgactaggtgactcaccttcttggcccagtgggcatttgatccagaataactcattactgtctgaggaaattcccactgtctcttttcccagaagtttttgtttctggtggcttcttgggggattccaggcacagtagggccaagcaatgggtatagagtgaccctacacctttgacttggcctcctgtggacttagatggatgggtgtgtttcctaggagccctctttcctgtcctcaacccttttcccatgagaaatgcctcttcttgcctcagaaacaaacgaaggggtcagtgtctgccaatgtctgctcagcccagagtgaatgtctgagagattcagtgtgaatgtgctggttgcctgctacagatcaggcttggcaggtggtggtaggtggttaaggttccagtttcagcatcaagtatgagttgttactgctcagagtctcagttttctcatctgtaaaatgggaagattcctagctctcaaatttataaggctccactggccgtgtgtaaaatgtggcaattagggaatactgttggctgttaactatatccaccaggacaggctggttatgctctggtaaaaaataaacccaaactcaatgtctgcgcccagcacacatttatctcttgtgcatgctatatggccatcttgactcagcagggttctattctctgtcacctttacttaggagtgttggttggaagaatcccccaaagtagtgccatcagtctctatggcaggggaaaggggacatggtgtatcaagccttgggcttgaaggtctattcccagaagagacatcattaccgcaactcacgtttcattggccaaagtgagtcacaagccaagtttaacttcaaggagcatgcccccaagcctctgattctaagtgctaccgccttaacacatttgagctcctgtaacaaaatgccataagctgggtgacttataaacaagagaaattatttctcccagttctggaggctggaaagtccaagaccaaggcactggcagatttggtgtctaatgagaacctatttcctggttaatagatggtgccttcttgctgtatcattacacggtggaaggggcaaacaaactctctggggcctcttttataagggcactgatcccattaacgacagctctgcctttatgacctaatcaccttccagagcccccacctcctaatgccctcactgggggctaggtttctccatatgaattctggggggacacaaacattcagaccatggcagcgctctcttccctcaccgcgtggctggctctccaactacaacaccatgccccatggctcacttccaaggagactttctggagaggtttgtcctaagagacagaagaatgcatcctgcctcaagttttagttgcataggttcaccctacagtgaggtaatagttacacattcttaatgaaaagatccaaaagcccaatacatcctgttctgcagcatataaagcatcttcttcagacctggtccaagactactctgggatttttgagtcagaagagagccagagcctattcagtatgctgtttgactctgatcccagcagccaccaccatgttaacaggatgagcagggctttcttcaactcagggttcctgtgaaattaaaaagaattctcatcttgactcaggattgttgaacactattgatacttcttccaaggtctcacaagagtttgcctcctctcattgccatgtgaagacctctgtgggggaacaatgcatgggttcttggggtattataggggactacagagaagtgtcacctccacccaacagcctgattcagtctactcctcaggaggaacacaaagtggtctctctagtgccatgaaaccccaaaaagtgtcaaccagtattaaaggcctgcctgatatacaaccctcgaatgcaacacagtgtccttctgaggccactctaaaggccaggaaaggtttgctaagaagtctgtgctgttaaaaacagaagaaaaagacccttatcccattgctctgtgtctggtggctatagggacagtatttcataaaaaaagaaaggcaaaaataattttcaaaaatgattcaagaaatgctgtcaaagatagcaaagaacagagtcctcagagaacagtgcccaggacaggataagcactcaataacatataacactgtgtagtgctgttgagtgctggctgttgttgagtgctagctattgttgagtgcttgttgttgagtgctagctgctgagtgctagctgttgttgagtgcttgttgttgagtgctagctgttgttgggtgcttgttgttgagtgctagctgttgttgagtgcttgttgttgagtgctagctgttgttgagtgattgttgttgagtgctagctgttgttgagtgctagctgttgttgaatgctagctgttgctgagtgcttgttgttgagtgctagctgttgttgagtgcttgtcctgcctgggccctgtttttagcctttgatgtacatttctccatttaacttccacaatagccctattaggcagctagtattattatttctgttttacagataaagattggttttagctcagagtagttctgaatcttataaaaagaaaaaaatatccccaggaactgaatcggctccaaaatagccccatcttgggctaaatatgggatgtgacaaagccaccatgaagctaggcccccctgtcctgacagctttccaccccttccctgcccctctcaccctgctttccaggggcaatgcacctccccacttctcctgggaggggtgggcatcctctcagtcccataatctgtgccaggcccacatatgaggacttgacaggattcagcagagatgcaggcctctgctctgctctgctcatctctttgcatatagtaatttaatgaggacaaaaactgcatagagctagtaatggcacgaccaagcagcagcttaagctttgagccgctaaactatgctgcctcctattgtaatacgattatattataacacaagttcaagagaccacccactgctttctttattggatcttccaataaagtggccatgctagtagcacaattccccacggaaatagataatgactattctaaaataaatccgaggacacacccagccacaaagtgggaggtgtattatacaaatgcaaccagggcctctggatctggcatttagacccacagcaacagcttgtgtttgctcagggctaagaatgcaggactcagacaccgagagcctctgagctgctgcaaactcatcaacccctccctattaaaggccattctgactaccctcagttttcctcaaagagcagttgagagctaaggtagggtagggagccaagaggaggcagggagagccagagatggcagccggcaacaggacacagaaagaaaagggacttcaaaggcagatctaataactcacagggctttttggtgcagagtctggagataatgcacagaaatgacaccttgaaaggggaaggaaaagaaggaagaacacatcatcagccccggacttcaggtggctgaaggagagaatgtatttggcatctaccatatctttgcatccttcaatgacacatttgtccatgtcactgatctttctggcaaaaaaaaaaaaaaaaaatgtgctgtgtgactggtgggatgaaggtaaagggtggccagatgaatcctctccacatgctgccacgctggccacccaggatgtggcctagaggtgcaaggaaccagacaccactggcctacatcaaactccaggccacagatggaaataggactgagatccctggacctggggcccgctcaggtatgaagatcaggtggattgaggatgtcactgccatcccctccaaaagcacctgcaggaagggggttgccatggtcaccatctgtgaacaggactcctcaaaatgttttctgttaataaattgccttcaagtaaactgaaaaaaaaaaaaaaagagggagagaattcacacaaaatgatgcccagtcttggtctgcatggtgaagggcccaggactgatgggcgggggctcatttgcataccacaacaccagggagagtcctgtcacctgccctcctgagtcctgaagaaaacccttcactccaattccctgtacactgcttctaaaggcaggaaatgtgtacagttctagaattacagtcacataaaatgctagaagaataacgtgatttatttaagtgcttagaggtacccccttgaagtttgtgttacctggaagttggcctcagggaaacacctcattgaccttctctcaaggataaatgagatgcagggacagggaagggagaaaggttattttaacatttcattcacagtccctgggattctttggagagcaccttaggaatgttcttaacctgagtcctcttactaagtattatcacatagtctgccaggctggcattattaaccctactttgcagctgaggcaactacaagagatgaccctatcgggctagtgaagtggaattcgccatgtactgcatgcagtcatgtactgcagtgaccaatccgggtctaatttctttgatgatatcattgacggggtagcaggggagaggcaagtgcaagagaagaaatggggtgaaacccactgcagggaagcttgggctggggcaggatcggggagccagggtatggggcatggttgggactgaaacccttgttaacactggctttagcaaaagaaatgggcaccacaatcccagaggacttccagaagcttcctccctcccccgcacctgggcacagagccttacctcccctgcaccctggccctgtctctctatttggcaagactcccatgtcatctgctcctctttacttcgggtccctcttggcactggaaatactaagtgaacccagcagttgcacaggattctaggaatttctcctttccaacttcctgaactggttttctaattcacctcagaggtaccttaacaaatcatgttccaaggccaggcacagtggctcacgcctgtaatcccagcactttgggaggtcgaggcaggaggacctcctgagcccaggagttcaagaccagcctgggcaacatagtgagaccgtgtctctacaaaaaataaaagaattatcctggtgtggtggtgtgtgccactacactccagcctggatgaaagtgagagatctctttcgaaaaactcacgctccacacaatcaggaggtctgccatccacagactccagacagatagttccatcagccagcaggagcggcatgggcaacgtcagtagcatgcacatcaggttagcttctctgaggtcacaaagttgcctggaagtggggaatccatgagggccaggccctccacaggaggaggacttccctctccagtcaccggcctccctgatgtggttccctcctctcagcccacatgctcctgccgaggtaacatgtccccccactctatgttagaaaaccataaagcccccaagagacgtttctaccaatcatctaaatattgagtttcaccttataaaatttataaaacgtaaagaacacttggaacagcccagttttaatgcctccagcttttgttttccaaagaacaattggtagacttggccccgaggggagcagagcccggctctcagacaacgagcctcaccagcaattctgtatcttcgaggcggcagaggtttttgtgatcttgtgtcatttctaaacacgacggtgtagatgggatcctcttcattttgcaaatgagaaaatggaaaaacccgagggacaaagggcctctctcaaggtgccatggtgagaaggaggcagaaggaagaggacctcgcccctgccttgattccactgactgctgtttatcacaccatgagtgtcttcagggagcagtcgttctcccgctggaatgtttacatgaggagcaaatgtgatgccatcacataattccagtgagggctggtcatcccctgcaaggctgaaatgaccctgtctgttttaatgctaaggaagcagcagcttttctcccactcccacacaggatgtgtgcagcatcttcaagtctctgcctcgcgtttctagatctgtagtgagctctccatggtcagggagtggatctttcagttgggtatttttctgaagcaactgtcattctttgctttttgtaacaagacatgtttttaaaatcctctgagagagaaagagtgttgccagaaaaggaatgaagagtgggagaaaggtgcattgtggagctgtctgagcgttggagtatgtcccaataacgaagagactgcggagaagcatcccctgtccccctccgtgttctaaatgtatgaaacctaacaaggtaattgcatgggaataacacactgtgaatgttatgtgggatttgaaattgtcatcccaagagtgaccaggtggagagaggaagggtgaactctttcagtctaaaagctatgttttaaaaggcagggttagactatgtttgtttctgcagtgtattttctctgcataaagggatttttttcctactttttctgctggtggacgtttcccttgggggagcctggccaatgaaaggtcacacagagaccagtcactctcaggaacaccagcagagccgggcagacacatgtcctaattttcccaggagcagactgattgaaccataggagggtctgtctgatgtttatcttggcagaattctcagatgagttagcaaatagtggctggagataaactgaaactttgagcaacctctggactgactctgattaccctccacaccctacctgcacagggaggagagaccacaaagccagcagcaaacagtaaacttttccaagaatcagagaggaaggagttcctgacaccctgcagcaaaaacaacctcaaaattcccctgaagacagacccatgggagctggggtcaaggtggccttgcgcttcaccgaggaggtgtcattaccaaacgtgctggacattggctacctacggaagaaagattaaggactgaaagaaaatagtggagaacatgcttttgacatgggggtaggacagggaaggccttgagcaagacacaaatcacaaaagcaaatagagaaagagtgatgtctaccttcaatgaaatgtgaaacttctgattcaaaatcggaaacctctataagctgagataaaagacaagcaacagagttggagaagatatttctaacatttgtatgtgtgcaaatgtatgtgtgtaatgtgcttatacatatacatatagataaatgcgtgcgtatacacatgaattctggattgttatctaggctctatgaagaattcctatctgttaataagaaaaaagaccaagatcaacaacctcatagacaagtggataaagaagatgaccagttagtccacagaaaagaaaatgcaaatggaagtgggagggcccagaggaactcttgctttatctaaattgtgttgattacgggagcatatgcttatattaattttataggtaaaaaaacagaaaaagtacctgaagattaaacctaagcaatgcgatgtgtcagttttgacaacacacaggaaggggctctcagcctgtaaaataggagcccttttgtgtgaagctgaccagatgcggagaagtttcaacagtcctagagaagaggaccgcaggggacagagagccagggaacagggcagggaggatctaagagggcacccggccaagcggttcactgcagctggtgcagggctcagctataccctggggctgggcgcttagcacagtgtggtcagatgaaggcaagcaagcagtggcagggactctccatttgagtcaaagtgacaagcagtgcccccagtccctgggaaggatgaaatccaaatttaattcccttctgaacaacattctacaatctatgcttcatttaggtatctgtaagcctaaaagagctgaaaaatcattttatttccccttccaatgtacaatttctaagacatttgaattatcgatgttgaagtttcattgagaatgagctgagtgtcctgctttcggcctgaaaacaaagcctcagccacagtcttcgtctcaccctctttctctctgtttattttcttttaaaaagtttctcccatttctttgttctttaacaaagagttgtgtgcatcttctaagctccaagtgctgcactggcttccagcagacaatggcaaccgtggccctgacctcatggcgtgactgaacggagggtctcggccaggaacgtgagggacgccagaaagaggacattggtgggcaatgaggggtcttccttgcgggggggtgttggggggtgtgctgtgcttccctagcagtccacgaccactggcaggggacaccccgggcagaccagtggtccaaatttataccagcgaaaagcaaatgctgatgccttcccaatcacggttccttcaaaggcttcagggttccttgggaagggaaaagaacattagttcagctcctgcgatgtgctgggactgtgctaggaagtttcacagatgctagttcatttagattggatatgcctcctggaccagtgtgctgtccattatggaaaatcaaaacagccattgcatttccatagtgttcacaaggagcctcatttctgggctcaggcaggctgaggcgttccagggttgagaatcagacttggtgactgagcaggaactgttgtcctttttctcttttgagatatgaaatttgcttcacatctcagaagagtgtgtgcctccatcccacacttgggacaagcgccgttattccttttttaaaacatctgtagaacatattaaatgctctgctttcttcacgggttaaatcatgctggggcgggaggcttgtggtgtaagagcggtgcactgtgcatccactagggctctcccgtcattccagttggtctccttgccacgccccagctcgctgcccccaggctgtcttggacagacacatttgtgttttgtaatagagcacatcatgcactattatatggggatattttataaaggagcccacgtgacacaaggaaactaggagaaaacaatcctagaaatccccaaagcttggaagcagggacatgcaagcgaggtacagcatatgctatcaagtggcaatgtccttccagtaggaaagccgctgttgtcatcagtttaggcaggtgctgggattaagcacatctaccactcagaaaataataccaataagaaccacggtccacatccaacatgggtctcccaaattctctaaaatgtggaagtgtgcagatcttagcatctctgtcctttctctcgcttcgaggaagttgggctcctgggcactgcctcatcagtcatgcccagtacctgtgtacaggtgcctcccctgctctctggagcatcgggactggaaggattgggaacagaacggagctttgattgatcctcttgtccgcacttgtgcctttcaactccctgtggtggagggtgacagtttagtctccctgtcttctcctggggtcccaccggctcctgaatcaaatcctgctcttcccctgcatgttctgagtggcctgtacactctgggctctctctctccttgacccctggaacaccacctctttggttcttagtaaaccggagccttcctacctggtagtagcactgacatcctcttcatccactggaagcttccagatcctggcccccacaacccattctctccccatagggcttccacagaaacacaacgtgtactgtgtgccaaatgactggcccagaggatgagtgagtgggggaccaatgtaggctaggggaggggtcagaagagaaaagttccaagagagtgggaacccaaggaaggcttcttagaggagctgggacacattggggcctgaaggaagtggacatttagacgatcataaagactgcagggatgtccaaccttttggtttcactgggccacattggaagaagaagtgtcttgagccacacgtaaaatacactaacactaatgttagctgatgaagaacaacaaaaataatagcaaaaagtctcataatgctttaagaaaatttatgaatttacgttggcccacattcaaagctgtcctgggccacatgcatcctgcgggcttgggttggacaggcttgagctaaagcaagtgtgttctgagctggagagaaggccagccccatggttcatcgttcgtggtatcaccaaccaatgatactaggaacagttggtgggtgcaggccctgggcagggcaataataagaaaaagcttagaaaagaaaaggaggaggaggaggggagttgcgggtcatggagggccttgaaagcgagactgagggtttggaccttaccttttcggcatactaccgagcaggaacccctgtcactgtaatttctgatgattctgccttccatctttgggaataacaatgacatagtcgactactcctctacaaaaagagtcgtcagattctttaaccatgtggggcatcttgttttggcatccacactagttctgttacagccaaagctgggggtgttggggaatgtcgcatgcttcaggggtatctgtgtagtgtgcattttacccagctgagctcacaactttaatgtgtgaaggtgatcctccagttcaggaggacagagttggtgcccctgcctgtaccatcctaagagaggtttctgcttcctgtgtcctgctctgtgggctccccaggtacccctgtagtttttgcctaatactttggaaccaacaataataacttatgaaatctttatttcaaacacagcttgaatttcatccattttcatcttacccaaagagatagattctctagtccgcaatctggatggtcagaatggagaaatccccttacctgcaaacacaggtcttttattttgtaaccactgtctgtctggttttctgttttggagtctcccagggtgatggtgccgccagataaaagttctaatgagagagggagggtgggagggaggttccggtggcaaggcagggcggaaggtaagcggagaccttctccaatcagaagtctagaaggcagggcacgcagtaggtctgcagaatgactcagaacccgcgtatgaatgctgtctattcatgggtccaggcttttgttaaagcctgggcctgcattttaaagagggagtcagggaactggctggactggtctgacaactaaggagtggtgaacacttcccccaggctagtactcaggtggatgaagtcatcaatattttctgggcagtcctaatctgtgattaacttttatctctgctgtgaaataacagcctccttttcagcctgctaacaataagttaacctggctgcccggctgggggatattttatgctgggctccagcagaggcacacttgagaagccatgtgggactcctgccctggagagagcccagagtagagggaggggtctgtatggtggtgggagtcctctcagcaatggtccttgtgattccggtatactctgatgtcctgacttcaaactcagcttacccaaagcaaatgtccactttcttccgtactcctttcttgtttaaagcctcaccactgaccaggaagtcttgatagagccatctagtaattcttaagtcctacctcatccaaccttgttttgactcctgcagtgagcacagctgccctcaccctcccctctctatgccctcacctttgcaggagactctcaatttctcagtccacatcagctctcagaccaccaaagcaagggttatttttctaaaagacatttgttcccattgctcctctgactaaagttcctactatgggacatttgcccttggcactcaaggaccttgcaatcaggctgagaacctcaggttctcaaactcaagaccatggggaatgtaataggtgaatcaggcaggtgaagtccaggactctttttggtttatattttgtttactcagttttgatggagacaagcataccagaaaattcacattcctcttaactctagcagtagacaaacaacagagcaagcaggatgtgaccatttatacatggcctcactgttggggaggcagtagggagtgttggagaccagggtcaggactagggctagggcaaggctaggaaggtgcccaggatgcatgttttaaggaagcactcactcttggggctttgcaagtacaaggctagcactgggagatgagtgcctccttaaagttggcttcttgggccttgtttgcctgacctagtctggccttggtgaggacagtggagaaatggagcatggacctacccaaagggatggctgctgatcagcttcacctagctgttgccaaaggcaacactgtggccccacttttgccaaatcttttcaaacattctgtgggtgcttccatcatagctattatcacctggcaagggagttgtccccacaggtaaccttctcactaagtgggggtgtctgaggccagggagagctctactcattcccctgtgtgatcccagcagtgagcatagagcaggtgccctgcaatgttaagcaaaaaaaaaaaaaaaaaaaaaaaaagactttggaaatagagttatggagccaggatgggtcttgagttagcctcactctttatttctttattcaaggaatggttgttcagggccagcggctcagccctgggagcactgactgcttcaagacacagactcctctgggatgccaggcagagtctgctcctgaaggcagactccactcttcatggggctccctccattactcattaggtcacagaataatagaaaaaggcaggaaagatgaaaaaagagaatttaagaacaaaacacgtccaggtgtggtggctcacacccgtaatcccagcactttgggaggctgaggcaggcagttcatctgaggtcaggagttcgagaccagtctggccaacatgaagaaaccctatctctactaaaaatacaaaaattagctgggcgtggtggtgggcacttgtaatcccagctactagggaggctgagcccagacaatcacttaaacccgggaggtggaggttgcagtgagctgagattgcaccactgcattccagcctgggtgacagagcaagactctgtctcaaaaaaacccaaaccccacccccccaaaacccaaaacacatggtagcaaaataataacaaattgaagtatgtctgtaatgacagcaaatgggaacttacctactccaagacagaaaatgattagattagatttctaaaaagtccaggtaggtcttgcttccaagataccatctaagatgaaatcacacaggctgaaaataaaggaatggaaaaatatacactatttaaatgctagcaatagcagacagattataataggagagagactatataataatcaaggcaccaaccgactcagaagctgtcacaggcccaaatgtatatgtatgtgtctaacatacacgcacctcaaaatatagtaagcaaattgacagaactacaagtctaagattacaacccatttaacttgatcaaaagttgataaatcaagcaatttaaaaagtactaggttataaaagatttgaaaaacaaaagtaacaagcattatctaatgggtgtgtgtgtgtaaaactttgcggccaaacataaatggtcatcatagatcatttaaaaacagttggtgatatacagattatttaaaaatttgaccacatactaggtcacaaagaactcaacaaatatctagaatcatcaaataacacagatcatattctctaaacacaacccaattaaattagaagtcaatactaaaatacagtctcaaactcatatatgtgggaactaaaaaattcactccctagtaactaataggctgaagaagaaattacaacagaaatttgaggagtttgagaccagcctgggcaacaatgcaaaaccctgtttctacaaaaaattagccaggtgtggtggtgggtgcctgtggtcccagctacttgggagactgagttgggaggactgcttgatcccaggaggtggaggttgcagtgagccattatcatgccattacactccagcctgggccacagagtgagaccttgttgaaaaaagaaagaatatctagaggtaaatttatagtctgacatgaatttatttcaaaatcatgagaggtttaagcgagctgagtgctcaaaatagcaattgtaaggaacttccttaatgtgataaaggttatctatcaaaagtgtatagtaaacattataattaatggtgaaactttggaagcatgcccatcaatatcagtaacaagacaaggatgtccattgtcaatatgtctattcatcagtatcctggaagccgtactgagggcaatgaaacaagcaaaagaaataggagtataagaatttagaatgaagcaagaatatttttatctgcaggaaatatgataatctatatagaaaattcaagagaattttctaataaactattcaaatgaaaatacagtccaacgaatatatatacacaaaattgggtacaatttatatgtattaattataaccaattagaaaatataacaggagaatgagtcttatatttcaactaaagctataagatctttctgcatacattaaacaaaatatgtgcacgttgcttggttttgatttttcttggttcatttggctggttttagaggaaacttggaaatacacctgagggacatgaaagaaaatattagtgagtggagtgattcaccacattcttaaatggaaaaactagtgttgatttaagaaagatgtcaggccgggcgcggtggctcacgcctgtaatcccagcactttgggaggccgaggcaggcggatcacaagatcaggagttcaagaccagcctggccaacatattgaaaccccgtctctattaaaaataaaaaaattagcttggcttggtggcgggcacctgtaatcccagctactcgggaggctgaggcaggagaatcgcttgaacctgggaggcggagtttgcagtgagccaagattgcgccattgcactccagcctgggtgacagtgtgagactccatctcaaaaaaaaaaaaaaaaaaaaggaaggaaagatgtcaatatcatctcctaattattctttaaattcactacaattctatccaaaatcttgaaggggatttttttgtgtgtgaaatttgacaagctgataatcatcaagactaattatacatttataatacttaacatagtacaatatcgatatatagatagtgaatagatcaatagaaaattagagaactcagaaactgacctatgcatctgtggaaatttcatatataacggaagagtcattacagattagtaaaaagaaggggtgggctcgttcaagaaataacttaggaaaaataggttatccatacaagaataataaaattagatccttatatcaacgcacatgtaaaaacaaatccttggttgattacatacctaagtgtaaaaagcaacaacttcaaataatttagaagaagatgtagaagactatctttatgaactcagagtaagaaattattttcttaaactatatacaaaaagacccttaatgcaaaaattaacagactatttggtttagtaagcaggattgtattttaaaatttttaaattattcataaaaaatgttaaatgtcaagccagaaaccagtatttgcaatgcagtcatataattgacaaaggccagaatccagaatacatgaacactggcaagtcaatggaaaaaatgaccaaaagacatgaacaagttatggatgaaggcagctcaaagggcaaatgagcatttgactagatgattacctcttagtaatcagagaaataagcaaacaaaaaagtatgccacctgtgtattagggttctccagtgaaataaaacaaataggatttacatgtatatagaaagagatttgttttaagaaattaacttccatgattatgaaagttaatatctcttccatgattatggaagctggtaagtccaaaatctgcatgctgggctggcaggctggagacccggagagaagacaatgctacagctcaagtcaaaaggccatcaggctgaagaccccaggaagagctgatgttgcaggtgaagtcccaagaacagtttgctggagaatttcctcttgttcagggagctcagccttttactctattcaggccttcaactgactggacgaagcctgcccaggctctggaaggcaatctgctttactgaaagcccaccaatttcaatgtaaatccccatcagaaacaccctcacagaaacattccggccaagttgacactcaaaatcaactacagaacctccaacacatcagactggccaaaacatttgtctgccactaccaagtgttgacacaaaaggcaaacataagaaactcatactgggctggtgaggatgtagagcatggatccagactggagaacctctcacacatgtgcacaaatattcactgcatcattatctgtagtgaaaaattgaaaaggaactgaaaaacaatcagcagaaaatagacaaattaattctgataaggttcatatgactgagtattatacagcagttaaaggagttagagcaacaggtatctgcatggataaatctaaaaacaatcatgagtttcaggaagatagatacaacaggacagatttccataaaatggaaaacttacaaaccaatactttatattacttaggaatgaatactgtaggaaaatctaaaaaacaggcttgagattaatacacagtaaatttaaggttgtggcatctctgaggagtagggaaagggaatgagatcaaggaggccttcatctgtgtctgtaatgttttatgtgtttttttctaaaggcttgaaacaaatatggcaaaatattaagatctgataaagccatgtgggcgtatgacatttgttatatttctctctatccttattcatgtgtttaaataattctccgaaagcagtttactgagagttcagcatgtctcctgagacatgctaggaagttatgtgcaggagtggagaatatgattcattggaagagttaagtgccctaaatgccagccaggctgtgaccccaggacagaagtagggtgggggggccttcttgcttgctagtgacaatctacaccaaccagcaccacaggagccccaggatgacaaggaaggacaaaacacagggggtgacagatgcaatgaacccctatgtggtacattgagtggtggagaccgggtgtaaaacacacgatcggtgcagggagaccagctatggaggctttggggaccatgataatgaccatccagtgtggctgtacttttctctagaagagggttggcctacatccactccagtggatccacattctctcccaagagactgataagagagtgaaagatttaagtcacctgtgtgggtggccctcaagacccctgcaatgaaaacccaaaggggtatcacagtgttttctggcaagaattggccattgcttaattttcttgtctgatttttcctagcaaccttgtatttgacctcgcctggcatcctgtgtggtcatgagccacagaggtggaaaaggcaacatggtagaggcaggaggaggcaggaggtggaaaagaagggttatcaggtgatgagttcagccatctcttgccctgagtttagttgtgctttgtttataaaaagtgcttttctacaaaaagtatttgatggtacaaaatattatcaatatggcttagatgggtttgagaagtaagaaaaggatcgtggtggtagcaggaaataagacagaaattttccatgggggctccaggtctgaaggcactggcaggtactgcagggtgcctcaagcaggcgtcacttgatagggtcaaaaatcagtaatgtctatgctcatctccaacctctgcagatagaggaggaaatgttgtgaagtatttagatgcattttcttaggtgcgttgtttttgttgaattaggacatgaagccagccacagccagctgtctctccccttcggtgagaaggggacgacgtgaagcacccaagatgtgaaccaggactcaattcacatttggggaacctgatagcctcctcagatgcccccacagaaatccagattgacccctgaggctgagctttaccctctgcagggatgacttccatccagcctgggatgggcaggggaaaccgctgctcacccgaagtgtatttaaggggtcccaacagcaacttatcaacattttttgttgtaaagcacagagagagcagtgaattctgtccattttgtgagcagcacatctggataaggcgggtgccccactgcattcagagcagctctgggaatgaggaaggaagagacaacaaaaggaacaggagccttccaataagcccagacattagacctgagccttgtccctgtcataggctagtcattattgattaaaaggtggacatcagataaacccaagagggacagccccgccaacgtccagagcaatgaggccctcactctgccctcacctctgccagtgtaaattctggggaatttctgaaacaccgtgaatacagaggtgtgactcagcgggaatcacaggaatgtcagaggacaaagcagttggtattaataaattgctttgagtctggaaacaaagaagtggccttctttgtttccaggctgaagtacagtgctgtgatcatagctcactgtaacctcgaactcctggcctaaaatgatcctcctgcctcagcctcccaaagcactgggaatacaggcatgagacaccatgcctggcctggccttcagtttctctgctctaactctgcgttgccctagaaatccttttctgaatttctcaggtattagacattcacccatgacatctgcatctttctcatcttcaccagaatcaccctgtcttaattccttaactcttcctgcttcttgccaggctaagaagctgtattagttatctattgctgtgtaacatgtcaccctaaaacgtggcagcttaaaacaaatgtgtgttatctcacactttctgtgagtcaggaatatggacacggcttagctgaatgcttgtaactcaaggctgctcatgaggctgcagtcaagctgtcacctgaggctttggtcttatctgaaggttgactggcatgggggcatctgtttccaagctcactcatgtggttctgtccctccccacctaggcatctccacaggctgccttgtgacatgtggctggttaccctggggtcgtgtgactctagagagagtaggacagaggacccaaaatggaagccacagtgctttttataacctatgaagatgtgacatctcattacttctgccctattctagtcatagaagcaagttacttagaatgatccacaccgacagggaaaggatgacatgagggtgaggatacagggagagtgggggtcactggggcccatcttagaggctgcctaccacagaatccctaattatttctctgaaaataaaaggaggagaaagagacaccatattctacatttctgctcacctctgtggtggggctgatgtgcatggttttcatggcttaaaagcacactccatctcactgggggtttcccaaatggtcatatgaagagaggaattgctccccagaaccgctggggcacctcatttcgttgatgctttttcttcctctccacggagatgctctgggtagaaggaatgaagccttcaaggtggactctggagggctctcccagaggcttctgtctgaaccagtgggcttaaaaatgagcaagggagaaccttcatgaaaatcactgtcaagtactgtctcagtttgctccagctgctgtaacagaataccatagactgggtggcttgtgagcaatagaaattaatttcttgcagttctggagtctgggaagtccaaattgaggtgctggcagattctgtgtctggtgagggcccacttcctggttcatagacagcctactcctcgctgtgtcctcacctgaaggaaggggcaaggcagctctttagtgtctcttttatgatagtactaatcttatttgtgagggctccactgtcatgacccgagcacctcccaaaggtcccacctccaggtatcatcccactggggatcaggcttcaacacatgaacttgaagacaaacatttggtctatagcaaacacccaccatataccaagccccgtgcttctctgggcttgggggtgctgggataccaaggtaaattaagcctgggctccatggcaagctggtgtgatggttgagagaaggtctaaggggtcagtaaggggttcttgcctggcacggtggctcatgcctgtaatcctagcactttgggaggctgaggtgggccgatcacgaggtcaggagttcgagaccaacctggccagcatggtgaaaccccatctctactaaaaatacaaaaaagtagccgggcatggtggcatgcacctgtaatcccagcactttgggaggccaaggcgggtggatcacgaggtcaggagttcgagaccagcctggccaacatagtgaaaccccgtctctactaaaaatacaaaaaagtagccaggcatggtggcacgtgcctgtaatcccagctactcgggaggctgaggcaggagaattgcttgaactcgggaggtggaggttgcagtgagccgatcatgccactgcactccagcctggatgacagaacgagactccgtctcaaaaactaaaataaaataaggggttctcatcctagtgctattctcagctgagtgactttgggagagtgacttgaccttcatgagcctcagtgttcaaaggatctttatgattatgtttgtgaagccctccgagtcacctctgagtctgagcatccatctaggtgctccatcagcagtaggtattcccagtgctattgcagagaaactctctaaacccacctctcaaactgggccagcctggagactggacccagtgggtctggatgctgacttgagcacacatgtacctcggctcctcaggaaactctcatgcaccccagtggctgggagccactggtctagagagtgagctgcatcaaggaatggtggcacgtgggaatgtgagcaggtgcaggtggacactgggccaaggtggggcgtgtctggactcagggcctcgttggccaactctcctaggacttaagaagggagaggagcccagatagaggagccagttttttttttatttccaacttttattttaggttcaaggggtaggtgtgcaggtttgttacatgagtaaattgcatatcatggggttttggtatacaaataattttgtcacccaggtaatcagcgtaatacccaataggtagtttttctgtcttcaccctcctcccatcctcccccaccaggagtccccagtgtcctctgctcccatctttatgtccatgtctactcaatgttgagcccccacttataagtaagaacatgcagtatttagttttctgttcctgcgttaatttgtttagggtaatggcctccagctctatccatgttgctgtaatggacatgatttcattcgtttctgtggctgcacagtattccatgttgtatatgcaccacattttctttatgcaatccaccatcgatgggcatctaggtctttgctattgtaaacagtgctgtgatgaatatatgcctgtgtgtgtctttatggtagaatattttgtattcctttgggcatatacccagtaaatgggattgctaggtcaaatggtagttctagtttaagttatttgagaactctccagacagctttccacagtggctgaactaacttacattctcaccagcagtgtagaagcattgaggggccagttttaaatcctagtcccttcctgatgctttattcatgctttattcctgcctcctgtcacccgtcttagggatgattcacccagtcccttgctcctggctggaaaaaccttttaaggaaaagtcgctaatctgggtacatctagacttagctttgcccgtggaaagtctcttgcttttcacagccatttgctacccaccctgcacctccccacacccctcagacttcatgcttgagtcctgtttaccaaatgatgggatcctgttttgtcacctcagtcccctctgaggggcagtcagctggctggagcaggaggctgctcaatcccacgctgcaggctcctgcacaaggtcagatgtgcaggccatcatgaagtgagtgtcgagggtggtgtcatcctgaaggttaacactgtagcggggagagcatggggttgcgtgtccctctccctccttgtgcaataactatcgtgggtaattcttttatcgtcttttagataatttttacatccacaaatcagaaaaggaatgagaatcaaacaaagtaatacatgtggaagaactcagagaacagtgtcattctatagcaacaatcaacacagagcctctgctaagtgtcaggccacattctgagcacagcggagacaggattgagcaaagccaccacagagttcacattataaaaatgaaacaaatgaatgacaagtgtcacacggggtaacaagcacgataggggagacagaatgaggagagcatgtttaacagtaagaggttcgggaaggaagccggcccagacctgagtgaaattagccatgcctgtgcccgggggaagcaggtgccagcaggaggaacaccgagcccagcctcctgaggtggagggcatggggcatggtaacaggctgcacaggagctctgctctggagcacgcgatccgggcacaaccaagagcattggtggcaccacttgaacacttgcagccagctcatgacagcatttaaagtgtctttgctgatttgttgaaaacaagatgtaaaaatcactcagtgagaaggtggtatagaccatcagcctaactccaatcctgctcgggcttcacctcccacctcccggctcacgtgccctcgcagcaaacttctcattgctcctcaatttatctccagccccagttcctctgttgaatatcttctgccccatcattgcccctgttttctaagaaccagctcaaacatcaccacctcggtggagattccctcctcctggggttcacccaggaaactccaaccaggaagcaggaggtgggattccttggatgaagaagaggtgagtgagtccccctatgatgtgagctagtgaagggttgtcatcagctcagagtcattccaaaatactcttaatacatttctgttttcattgtatctttaggaattagtggcgatgtttatgccattgcagaaaaaaaaagaatgatgctccatttcacagcttacagagctggtttcacatacacttgaatggtccagctatttctgacagctacaaaacacaggcgcacacaccaccttgccttctgggaagctgtaggagacacattacctcttgacaggataaacagccacacattagagggtaaaggcagggcaagcttcaccccagcacctcctaacctggcacaggcttgaccacatgctacttcaatgacttctttttgagatcaaacacctgcccagcaccccagtctcctgacttcttgcttggagcctgcatctcagcttcctcagcagcaatgaaaaaggaagccaaccccgacctgtagaaatagtgtatttcctcaattccaaggcacacaattgttcaaattttaattattctgaaatcaggatgtgtcttacaattagtcggtacactacatgtggggtttcttttttctttcgtttttgttcaccccctacaagctgttcttaaaacaatggtgtgtcatacaattgatgacatcttagaatcaaataaaataatagttaaaatcatggggtggcaatttaaggtccacccgtgtcagacttctcgaagtcattgtgaaactgtgttttgttctgctttgaatgtctggtggtgtgaacccagagagactggattcctagatccctgaggcctcctggccgagccaggagcatggggcagacaaagggcaaagcatggtccctaccgacttgtcaggcctgccagccctgccactggctttgtgattttcattcctgaattcatagagatggctgccagcaacgagaggtaatctcaggacacacaggcctgggctaggccttggaatattccggaagtcggtggccagagttgtatcaagccagacgggacacatatgggaatacaattacagcaaagcctgcaaggctcagtgaggggcagagggcctggccacatgaggagccagtgctgtgggcaggcctgggtctgagtgccagctgtgtgtcctgcacaaccacatctcccagagtgcattcgtcaccatccactccagatgccccttgaacaaatgaatttcacagttgcaaaaggctgaaaaatgctctgtgacctggcacccccttggggaaccacagtgcattaaaggctctgagaagtcctgcagtaaagaaacctgatgaacttttgtttaagttaatgttttccaaacttctttgatcacagaatccttttattccagtaacaccttttacaatcttaagatgtgaattttctgcagaacagccacctgggaacaggcctgtcttgtgcagaagcctgagggactgggagccaatctcatcactccctcacttgattatggaaagatgaaaacagagagtggagaaatgaagggtaagaccagggaagagattctctctggggtcccaaaacatggccctggctatggacatacttgggggtggggggatccacttgcctgctggcctcttttgggcagttggtattggttgcccgggtatccccggggcagtagctgcagcagtggcctgatgggtgtgcaagcagctagctggtgtgtccagcacggtcttggcacacctggttgttttggaaaggtcttttcttgaacaggaacttgcatactcaaaaacaacagcaaaacacaaggccacactcaccccccaagggtaagtccgtggctcctcctgcacacccaggaaagatcccgtggaaacacagcaccggaggatatgggataagagacaacagagaggagtggtgcttcctgaatttaggaaacatagctgctactttgggccctctagatacttgaaagaaaaaatgatggaaatcactaggtgagaattaagttcttggtgaccactggctgtatgcaggacaaatagtactacaaagtactacaaagaatgcaaatctgtctgctgcacccagcaacttccagttggtaaaaggctatgtccctggagaggtaataactgccactgtaagaaattcctagggtccaatcctgaatccttctctcaacagcaggattctgggaaagggaagccaggttgttcatggacattcagtggaagaattaaggcaattaaatgttaagttttgcagggctggtcgacaagagaagaagggaatcataggtaatgagcacaactaaaatgaaggcacagaagcaagacggtcaggctttgctcagagaataacttcaatgagagcagtgagcaggtgctccagggtcctgggagacagtgggaggtgggtcacagagagcaggctgaggagtttggatctgctcatagagaaatatcttaaactaacagattccacgtcaggcaaggtctcttggcttcaaggagctggcagtcaggagggagcgatctaatgctgggtgggggttgagagcatctggtggaaagagggaggatgtgggcaaagagtttttccataggtggtgtggttgtccgaggggaggccatgaacagagagaactgaggcagggagagggaagcccacaggccttggggttgggtcagaggaggtggtcaaggagggaaaggaaggagagaagacaaggagaaaggaggggaagagggaggcacctcccctctcactggtgtcaggattcagattgtgactgggctttgcatagagcaggtgggcagctgtgacccacacatgatattccacccgaagatgtgtttttctgacatgcacagtaattttcaaaagcaggaaaactttatatagatatctagatttctctagataagtggaaaggcctggccttcctggacctgcacctggcagtgccacctggagctggtcacagctgctcccacaactcctggactgggcgcttcagttggctgtagtccccacccttcctactgcctcacacccaggtgacttcactcacgtccactgacaccgtctgcctgtccccaaggacactgaagtttgcaacctaggtgcagattatgtgcacacagggctgccattcacaggagggagatggtcagtggggtaggagggcgctgaaatccagcttgcatgcatgcccatgttctctgtatgtcccagggaaggaggtcccttctgtatttgcacaaagacatcgtactggctgaaaatggccctgcccgcaaattctcccaaaggtgtgtattctccattggtcacaatgcactatgtagcccatgagaaggagaccaactccggggagctgagagtgagaggagactgcattctcagacacaattgtccagacacttcctttaaaaactacacgccaatgcccaataatgctcagccttggaaaacagtgagtgtctaatcaagccatttaaagcagggagaagattttaattggttgcaagggctggtgtaattatttacagcatacagaggttttccttttgaacctcacagcaatcaagtgcagcagcaatttttctttccctattttgcagatgaggaaatggaagcttatggaggttaagtgattggcctcaggccattgcatttaatactactaataatattaacagccatagtccatcctgggcaggcctgagcatctcacacacatttgctcatttcctcctcaccccatgagagcactgatgctactttttcctctctcccagaagaagacagaggcctagaagagtctgggcagactccaaagcccacccttctagtcccaatgtgagacacccccattaataacaccaaagggcccacacctaaaggcaaatcagtcaactaaaatccaggtctttggtctagaatctgtcactcttattcctgcataatttttaacactggactcatggtgccttgagctgaaatggttcatgcaggatatatcaaaaatctgagcattaaccagagtgtttgtaatgacaaggaatctgtgccttttctatgagacataccagctctgtgtttgactctggtcagtgtaggcgttaacttctgatctgaatcagcaagacctgggttccagccttgccctgcaacccaccagtggtgtggccttggacccatcgcctgcctgtcaaggcctcatcttcttcctctgggacaagggcacagccacagcccccgtgttatggcaacacatgggtcaggctcaggtctggcgcttggcaatcagctgatgatggcagggaggctctgcttcctgtcccaggcagaggggatggcacggcctgtgagtaatgcaggtttgagtggtgagccagttcagagcaaggctgggaggacctttgggcacagtcaggctccagggatgcaaggcgtggctccttcaacttgtctccagcacagccacacacgccaccagtgtggggagggagcccctggtcattttctgctggggagcagaatcgctgatgaagggcccagcgccagtggggaagaggcctccccaacaaccctgggcctcctgcccgctcaagccacttaaaaatccgtaccgtgcccacaaggctttccagtctccatgtctcaggaaggtccaagacagtaggtggaggtgggcacatgacagggctttctcattgcctccaaacaatgccatgtgctaggccatattttctgctcttctagaagcttctgtgtcctgggccaggtgggtgctcattgtgttccctctgtctctgggatcccctcctgctcaggatttagggggattgggtgccctgtgcccacctgccagctcccatttactcacaccaccctgcaggctggaggcttagccacttctcaggaggagcctagaaaggatattggtcgcccagctgctgaacctgccccagcatccttgagggtcttgaaaaatctattttatgctgggcacctgtaatcccagaaatttgggaggccgagacgggtggatcacctgagatcaggagttcgagactagcctggccaaaatggtgaaaccccatctctactaaaaatacaaaactagccaggcatgttggagcatgcctataatcccagctactcaagaggctgaggcaggagaattgcttgaacctgggaggcagaggttgcagtgagcgtgagccgagattgcgccgttgcactccagcccgggcaacagagcaagactccatctcaagaaaaagaaaatcttaaaaaaagaatgccactgtcatgtggaaacacctctaacaaacatgaggccagctaagctggggtgggggccaggtggcagcctctgaggaggcctctgcagtcctgggtggatggttcgggtacagcctgtgaatatgagaagctcttggccactgcacatggctcagttcccatcatcgtgcatcagacactggaagacagtagttggagctgctggacagggctgttttttctcaaccagacagtatccaggtgcctgtccctcagcagagggagaggtgccacaaccggctaccatgataaggagtcagctcagagcacctttgttggggggcctgaggagatgaggtggtatggggataggattctggaggaccctgctggaacaggtagaaggacaagaataactccccactgggactggaggagaggaaggcacatgggggcccttggcagggtggagtagggccataggtaaaaggaaagaggagaaaaggacagatactggggagagtgagagggaagggaggggaggagaagggaggcggacacctccagatctggcatggcagaagtctcctcggaaaagatgagtgcaagatgtgggaggaagagtaggacgtgagggtctccaaagtctgctcgaattttcaggtacaaatgacctcccatcagaatagccccaatctgagttctgcagaggctgagagccaactcaagggcatggagtttctgaagccagaagggaccttgataaacaagaaagcctgaggcccaaggaagttaaagtgatgtgctgaagataacccagccaaaagggggcgcagcctggatccacacacttcatggtgctctacccactacaccataaaaggagagtccaaacatggtaaagatggatggcagactggcagccagtgctgtctccatgacagcactgtcatggagattgacattgacattgacattgacattgtcatggagatttacactgtcatttacaacctggcatgctttagatggtaaagtaataaagcagaattgatgtgtctaaacaaagacctccagtaccttggaaaactgcacacctttgtttagcaattgcgttcacatttagtaattgttttctgagtaatccattcatcattcatttattcctatgtctggtattggcaatttaaaaataaacacaacagaactcccactgtataattgctaaacacaatgacagctataattgaggcactgaaggaaggtcaggggagcccaggagggcggggctgctgctgcctgctgagctgggagggttggtggcaccccttgccctgggttgccatagcagatatcataatcaattacggccgtctttcatgaggaacctggatctttcccaaggaatcagtgagaagtttcagctcacataccatctctgatttgccatccctgggatgttagctgaatcctctcattttacatggaggagactgagggccacagagttcaatgcagggcctagtttagactccagaccagctgccaagagagatgaagggctggtggagaccagccagcaagtggccatgccgcccgctgcagaccccacttcacactctcatgccacccccttgggttcactgacaaaattatgctcacaaaagcagtgctctgatttctatgagatactgtagaaaataacttgttttttctttttgtattactttttattgtatgatacatattcatttcagaaaaactagaaaatacagctaaattggaagggaaaattaaagtcactcataatctaaccactgctatttacatttataccttattggatatattttcaatatctttctaggcatttttctctctgcttatgtgcctgtggtgttatgatacatatgcataggttttcattcatggttcctggctcatcactctcatagtccttgttataatgttgggagcgttaggcctcaggagacaacgtccctctctctgagtttttcctgttctcctttctcctgcccaaggcgggactctaatccgattgtgggtcaaaagaccttcatttcagagcaggtcctgccccagcccctaaaggaagaaatgctgcacagagaggctaggaaaagtctgaacgggcaggtcttgctgggtttagattgtgttctttttgcccaatcacatttctacatggttgtcagtcatgccatgtaatgaaggctccataaaaacccaagacgggccaggtatgttggctcacaccagtaatcccggcactttgggaggccaaggtgggtggatcactttagcccaggagttcaagaccaacctgggcaacatggcaaaaccccatctccaccaaaagaaatacaaaaattagctgggcatgatggcttgtgcctgtggtcccagctgctcaggaggatcgcttgaacctgggaggtgggggttgcagtgagctgagattgtgccactgcactccagcctgagtgacagagcaagagagagagagagaaataaagaaagaaagagagaaagagaaagagaaagaaaaggaaaggaaaataaaaggaaagaaaggacaggaaaagaaaggaggaaggaaagaaagaaggaaagaaaagaaaaagaaagagaaaggaaaagaaaaaagaaaaggaaacgaaaggaagggaaaaggaaagaagaaggaaagaggaaggaaggaaggaaggcaggaaggaagggagagaaaacccaagaggacagtgttcagagagctgagcacgtggagacagactggaaggtggagtagtcatccatgtgccgagtgggtggctgccccagctccacgaggaccagactcttccagaccttgccctgtgtatctcttcatctggctgtttatttgtatcctttaaaatatctttctaacaaacctataattgttaagtgtttacccaagttctgtgagctactctagcaaatggaatccaaagagggggtcttgggaaccccagcttgaagtgggtcagtcagaagttccaaagacctggacttgagactggtggaaagtgggaggcagtcttgtgggactgagctcttaagttgtgggatctgatgctatctcctggtaggcagtgatggaagggaattggaggacacccagctggtgtccactgcttggtgtgtggggaaaatccccacacatttggtcacagaagccttcttctgttgttgattgctgttgcagtgtgagagcagaggaaaaacatgatttgagaggtttttccaaaatggttcctgagtggtaatcacagtaatccatccaccttgtgagtgtgcatgcatgcttatgtatgtgtatatgggattacataaatatggctcacatgtgtatgatcgtatttgcacactcccttgtccacttacttatatatcaaagtttccctcataatgtctgttctgtgtcactatgtaccctcccctgtcctccattccccacaccaagagtattatgagtattaaatgccacgtgggcaggttccccaggcaatgagggggtgggcctgtcaaatgcaggccatgcagaatgccacagggcgggagacgggtgagccaagggagccgagagttccagataacagagtgcacagcaaatgccatggcccgcgtccagcaaccaggagaaacagaactgctgagctcagaataggccaaggccgtgtctgctagcagggagcaagggcacagcctgctgtctggcctcttctgccccatccctccactgggacatggcccagatgagaaagagctgccagacggcaagtcaagtgtggggcgggagaggacaacgttttatgcaagagtggattctcggagcctctgcactctccatcagggctgctggcatggaaaacacagagaaaccatcacctaggacttgattgaactactggacttcccagaagagtccaatttaaagcaaagaggtccagagaaaaaagcattctagtgacatttttatatatttaaaaactggaaaaaagaaaaaataattagaacactgagttcccactgtctatgaaaaatgggcccagccccactgacaaccaacacgcctcacctcacaccttcccctccgccttcgttctggccgtgagccctgagccgaccatgcacatcttaccacctggagaacctcaaactctcctcttgcccacccccaccaagccccacattcaaaaggcttgcctgagaggcctgcccacttccttggcagttctggcctccagtgccctggcaggtgagtgacttctctgtcctgtgtagcatttggtacaggtatgtactgcatttataacacttaccatactggcttggggttgtgacacatcttcaagggagtccctggagagcagaaagcttgtcctattcatgttttgcccatcttgttcctgaataatacctgcacattgcaagggatcagcaatatttccaaccaaaccataaacttctccatctccccttgaagtcttctcgataactttcccagaaactcccagaaacaacaatggctgtcactcactgagaccctcctatgcgttaggccctaggccctgtgccaagccttggcattcacgtgtcacttaaacttcaggtagattgtcagatttagcaaaaacaataataaataataatttaggatatccagttagatttgaatctcagataagcaacaaataatattttagtataagtatgtcccatacaacttttataccaggcatcctatattttatctggaaatcctggccccagggcaaccctacgtgagaaacttgtaggtccattttacatgtgaaggaactgaggctcggagaggttaaacaactttcccacggtaacacctgagatggaatggcaggcagctgacttcagagtcccccaacacggcctttgcttgtctgggagagggagctccaggtggaactggtaaagggggtgaatccattggctgggagatgtcatgagtttgagactatattgggagcacccggcacatggtggccatcaagcaatttttagtctctctctcccttccttcccttgcgccaaattggaaattcccttgagaccctcacacggagtcctctacaaacacattgaatttcagccctcataggaaagcagaaggaagaaggatgatgttgcagaagatcgctgccatttgatttattacaacagtctgaggcctcagagagcgcagagcaaagagaccctggaatgcagccccagatccctggaagagactttacaggtgtcacgttggagagtggagagtgagggggatggtctcaaagaacaggagcagagattatcagagacaccacaaacttgaaaagtcaggatgggtaggacttgaggagaaaaaaaaatcttacctttacaatagcttcaaggaccacaaatttaagggctctccagaggctttaggacagagtcaaggaagtgcttcctggtcgaccctttcaacaaaaactgtgcccctggtctcactgctgcaggcagtgatggtggtgtcaacatctgctcttctcgggctccctccacgcctctgaaaacatggaagtgcttttacccatccagaaagaggggcagctgaaggaaggaggaaagggggtggtccagcgcaggcgcagcctgttgggaaccttctgctctgtctgagcatttgtgatggttgaatgggctggcacgggcgtctaaggcaaggaactgcaagggaggctgcagcctgccctcgtgacccagcactcgtcagatggccggagtgggaatgcgtcagagatttgcctttggacagaactgaaaggatatgaagcagggatgagagaagttctttccataaaaatctgaaaaccaaagggccaaactgatcaacttgcagaacgggaaggactgacaaaaatctcaggaaatcaccaaggtcacaggggaagatcatgaggaaaatgtatgtgaggctcccagcccagccctgccaccacacagtgttggccctgactgccactcacctgggtgccccctggactgcaagcacctggcaggggctgggctttattcctgaaacagtagggggtcctatagcacagcaccaggagaatatatagcaatggatgtccaccccatcctgcaaagtcctgctcaagggccagcccccacatccccagctagaagccgcctctccttctgcaacgttctactgcggctctccacctctcttgggactggaagtgagaagcatttttcacggtggttcacaaggtctcagtgcagatggaaaacagagagtaggtgagttggagagggtggcacagactgaaccccagacaagaaggctgcctggggactcagccctggtctgttagcagttacgggtacccagagcaggaaagcaatgcagaagggtcactttaccccaggccccacctggagcccagctggggctgtccacctgcttcttcatttgtctttcctcccagatccacatcctcgcctcacatcaggaaggcccagtgctcacttttacccaccatccgcctcctcccagttgggcgagtagccctggctgctgcacagggtgcctcccgtatgccaggcactctgctggctgcagggcagcttaacctgcagggcggtcaggacagacagaatctttgctttttcttttcatctgatcagggacttctgtctgatcagaattaggtgtctgggctgtcccaggcaatgcacgacagtcactgggctctcctctcgaagattaaccctttccagatggccacaatggtggcggcagccaagcgcccacctccacataagtcttccctcttctgtccaagccaaatccactcacaggaaaggatctggaactacatggagctaaggagtaataactagagacagttcactaggatctcgtgtggagcaggaaatcaaagttggggactgcatcacactgctgcaatccctattaaacatttgttgttcaaagttctttctcaatggcctgctggaattttttttcattcttcctctttggcctgtcttccagcagtagcaccagcctccccagcttctcccgtctcctcctggacttcctcatagctgtaggcttccatgttctcaactctattattcagaggagttcagctcagtcacgtctgcgccagagctttgatgacccacctgtcagccacactaagggccctgccatgaataaggcctccgtcactgaggatcctgtacccctctgccataaactcagtgacctgactgccagccaccaggcagaacctactagacttctctaaaatagataccgtggcctccttcctcaatcatagtcaaggtctaagcttccttatcaaaggcaggcagtcctgggttttacggcaagaagtgtgcttcctatgtgcaaggtgctgtggggaagggctgagtgtggaggccatgtgtgcaggtctttaggattttagctgagctgccttttcttgcagtttaagaaaaaaacagccagccgttccctccttgtaataaatgcctctgcatatttgaagacagtagttaggtcattcttgagctttctcatcttcaaactaaacaacagtggcccctgtaacctttccttggcaaattgtaaggcccatatgcagaggaaaagcaaaacaaaaccatctgatggggaaggcctcctatctctaaccaagtgtctgttttgaaatgcggtctgcactcagtctttaattacatgtaaattcagtagcttcaagtgtctgagccagtgggagaccaggtgctgctcatcaggccccttggatatgttcatgctgcaaggctgggtgatagcacttggcagacgctaggatttcttctcttcagattcattttggggcaggaaaaggggcttccgtgagtgacccaggagcagtcagctgacacttcctccccaggttccctgagggtaggatgggccccaagagcctccagagagcctgtggcctgctggaaaggctgccctctgcctccacagaagccagcaagagtggcttccagatgtccctggtggaggctggcagcctcatcctgcagccagcgtctcccaggggaggcttcctgctgctgctaactcagagacaggggatctgctaagcgcctgccctcggtgggggtgttctgatcacatcaacttctttcccatggttctttccaggctcctttcccacatttgcagtgtgttatcttgggagaccccatgtgttagtctgtttgtgttgctgggaatacctgaatctgggtaattcttttttttttttttttttttttttttttttttttttttagacggagtctcgctctgtcacccaggctggagtgcagtggtgccatcttggctcactgcaagcgccaactcccgggttcacaccattctcctgcctcagcctcctgagtagctgggactacaggtgcccgccactacgccaggctaatttgagtctgtgtaattcttaaagaaaagaggtttatttggctcatagttctgtaggctatagaagaagcatggtgctgggcacagtggctcatgcttgtaatcccagcactttgggaagctaaggtgggtggataacgaggccagtagttcaagaccaacctggccaagatgacgaaacgccatctctactaaaaatacaaaaaattagctgggcttggcggcaggcacctgtaatcccagctactcgggaggctgaggcagagaattgcttgaacccagaaggtggagcttgcagtgagccaggatcgtgccactgcactccagcctgggcaacagagcgagactccataaaaaaaaaaaaaaaaaaaaaaaagaagaagaagaagaagcatggccaccggcatctgcttctggtaaggactcaggaagatttcactcatgaccagtcatggtcaaaggggagcaggcatgttacatgtgagagagagagcaacagagagaaggatggaggtgccagattaaaaaaatccaatcttgcagaaataagtagagcaagactccgtaccgtggggacggcaccaggcccctcatgagggatcctcctccatgacccaaacacctcccactagggcccacctccaggacccactggagatcccatttcaatatgagatttggggtgaatgaacatccaaactgtatcatccaaggtcagtgcgtttctctgtcctccagttttgcctgccatgagcagctttcctgtgagccagctgtccttttcgtctccagggtcattttcttccttcagtgcccagtgtttggactttaggctgaccttcaggattgtggagtcacagaacaagctcatataagtgtgtaagcaggcagcaaattttttaaaataaagaaaaagttatttagactgtgccagtcagtctgtgtgccatcctagctacaacccagggtggatgctgagtggagggtagaggagtgcatccctcactcttatctgtgcttgtccttcttgcatactgctgaggccaggagcacctagatttgccccagtgggactcacctttttatttatttttatttttatttttatttttatttttatttgagatggagtctcactctgtcacccaggctggagtgcagtggtgcgatcttggctcactgcaacctccacctcccgggttcaagcaattctcctggctcagccccctgagtagctgagattacaggcgtgcatcaccacgcccagctaatttttgtatttttagtagagacggggtttcaccatgttggtcaggctggtctcgaactcctgacctcgtgatccacccacctcggcctcccaaagtgctgggattacaggcatgagccgccatgcctgacctggactcacctttgaggagacacggttttggccaaaatagctgttaagtacaagtgttcaactggtgcccaaccaaagggaaagcaatcttttccaacagtgaagaagaaattggttgtgtctgcttttcaacagcaagggggtgagtctcaaatatggtgcctccattaaggtgttcaataatttcaactacatgaaaaatgtgccttgggaatgacttcagaacttaaccctccagggagaaatgcctctactgtatggcccctggcctggtctcagattggatcataagctccctcattcttgtatccccatgcccaaaactgtgcctggcacttaagggcccataatacatatttttggctttgttgaatagtttaactcattagtgatgcaaagtcccaactgcatatttagagatatttatgtgtgcactacattatggatcgtatgggtgagaagtaggaactcaaagagaataaatcatactttccctccccaaaatgtttataaagccaccaagaagacaggacatagacacatcaaatataaataaaatacaaaaggatgcaccctgacatgccaaatatgtgttcacagaaacaaagttcctcttgccaaattcctgttgtctaaagcagtttttcctaaaacatattcttcagaataccagtttctcagagtgccaatgtgaggaaaagctttggtggtcagatgagtgcagggctgggttaggctgatttctttaccagagggcttcctgaagacttaaagaaatctgtattgagatataatttgtatagcataaagttcacccactttaagtaaacaactcattggcttttagtatagagttgtgtatccatcaccacaatgtcactgcagaatgtttccatcaccacccaaaacacctcatgctgtttgcagccatttcccatccacttccttcctagcccctgacaaccactaatttaccttctgcctctatagatttgcctattctggacatttcatacagatggactcatttactgtgtgatcttttgcgaccagcttctttcatttaacttaatgttttcaaggttcatccacattgttgcatgtatgcactgatggacatttgggttgtttccactttttggctatcataaataacgtcattataaacattcatgagcaagttgtatttgaccatatgttttcagttctcttgggtctatacagaggagtggaattgctgggtcatatggtaattctacattgagcttttagaggaactcccagactcttttccaaagcaggtgcactattttgcattcccaccagcagtgtacacgagttccagtttccctacattctcaccaacacttattattgtctgtccttttttattatagccatcccagtgggtatgaagtaggtatgaagtagtacctaattgtgattgtgattttgatttttgtttccctaatgactagttgttttgagcatttttcatgggttcagggcctttgatatgttgattttttcacaaatcttcaaaaggggacacagtcggcagcagttcctaaatgcgttggaccatggagccaaacttgcaaaagcagctcctggaatgcaagcgcgtacccaaaagctgggaaacattggctggaaaccagcctgtgctggaaatgtgagtttggtgaatgtccttaggtcattacttctgcaaattttgctcaaagaaagggaatctgaactctccacttttgtacattaagataataataataataataattttatcccaagatatggcaccctggcatgatgaatattttgaattaaaggcccttggagacaagcagatgctggaaaaggcttttggttatctgtataaagattggacccaccaaggacagcaattgctttccatctgttccctgaaatctcgtacctggatggaccttttcacaagataatgtctgtttctcaggctcattaaaattcaaaagagaataattaacaggttagtttctgtcccccctcccccaccatctattcattctcactaatactcatttgttgcccctaacaagaattacctacattccccacctcctctctttcctatgaggccttgctgaaggtcaccactgtgcctttacactcaccccccttcctttccctactgcttacctgccccacaagccagtcatggcctctcctctgagccctgtgagaattcttagaggttttatcctcagtataattcaaatgtgttcccttctccaatacccaaaaacatggtatgggattattttttcagtaaggagacaaatagaaaggaggccattcaggtcttctatattttaagaccacaatcttgactgaacctataggtgacccagtgtgcataagctgctatttcctgtcctcctagtcatctttgtgtagaatcaaagacacccacctccttggtacctctcatttgtcacttttcaacacttcctggcaggcaggcagcataactggtcctgctgggtgatccagaccacactctgcaactctttcttctgagccaggctcccctactgtcttttcatttatgtcaaggcaggggaagacctcaaagggctcttgcatcccagtcccacttcccagagaggcacgaggccctccaggatgtggggacaggaactttggggcaagccggggttgtccagaagatcaccaggagggctaaatagtagaaaggagagtcttattggtgatatgtttgcaaactgggaaaagatagcctccagtgtggagcaaagatgctccctcttcaaagagggcaagggcagcttggattttgtgccttacagggtcggtattatataatagagtcatgcatattcagtaggtttggggggaaagctatatatatttatgaggggagccaactacatgggcaatggataaacatacatgtaacacatcccatgttcacttaggggcaggattttagcattaaaatgaggtggaatttggctctttacatcaaaaggtgagctatcagacacaaaggcagtttgtgcacaagctctccaaagggacttgagggctacagctgctcatctggaaagaatccttgtaagaccagtcctctgtccaaccagagttaggaggcgtctgacaatttgcctgattagctctactgttgggagtttaacaagggtgtggtttttcttgtaaccataggaatttagggagttgccacgccagccaagccctaaaccctgggcttataggtaactttttccctaaccttaagatctgtcttagttggtaaaggggtgtctattttggtctctcagatcacactagaaacctctcaagtcctgtattcttattataaagctgattataaagctttacaatttactttgtgattactgtagcttatcgtaaagcaactgtaatcagtaggattggtgtcaagatgggtacacagatgggtagaaaagaattgagaatccagaaatagactcatatttacatggtcaatttatttttgacaaaggcaccaaagaaatttagcatagaaagtataatcttcatcaaatgatgctggaaaaattgagtaactatatgcaaaaaagaaagaaaagaaagaaaaaagtgaaaacctccacctccgtcattacttcataccatataaaaaattaactcagaatagatcatagacataaatgtaatagctaaaactataaaactcctaaaagaaaacaggagaaaatagagaaaaccttggtgatcttggttttggcagtgatctgttaaattcaatagataaaacacaaattagaaataaggtattgactgaacctcataaaaataaaacataaacttttgttcttcaaaagacatttaggaaaatgaaaaggaaagccccagactgaggtaaaatatttgcaaaacatatatataataaaggttttgtatccagaatgtataaagaagttaagaagaaaagcaacatactttttttttagttgacaaaagatctgaaaaagacatctcaccaagtcgtttgtaggactggcaaataagtaaacaagaagaggcccaacacctttagtcattagagaaatgaaaactacaaccacagtgagataataacacccactagaatggatgaaattgaaaagtctgaccatatcaagtgtttgcaaggatgtggaaccaacaggaactccattcacagctagtgggaatggaaaatggtttgaccatgctgaagagcattttgttgtttttttaaaagttaaaaatatatctaccatatgactcagtcattccacacttggttatttacaccccacaaaaaatgaaagcatatattcacacaaaggcttttaaacaagtgttcataatagctttatttgtaattgccaaaaaccgaaaatcacccagttgtaccccagcaggtgaatggataaaccaattgtgacgtagtcatataatggaatgctaaccaataatttaaaaaaggaacaattgatacctataacagcattattgaatccaatagaatgatgctgaataaaagaacatggacaaagaaagagcacatactatatgattttagttacataaaattctaggaagtgtactaatctatagtaacagcaagcagatcagtatttgcctattgggggaaggagtcggacagcagcaggggaagggttaaagtcacattttagttttaaaatattcagcatgtattttgggctacaaaatagcacaaggaaactcttgggtgtgatggacatgttcattatttaattgttatgatagtttcagagacataaacataaaaaacttctcaaatacacacttccattatgtacaatttattatgtggccattatacttcaataaaactgtcacggaagaacgacccttatcttctggaggtacatgctgaatgtcttacaaataaaattatctaagaactgaaattggcttcaaggtaaagcaggaatggggtgagaagtgtgtgtgacgtggacacaagggtgatatagaagattggcatcaagtgacagaagtagacggtagattcatttttatatatgtttgaaatactacattacaaaatgccagtagaaaatctgagtctaaccctaagaatgcagtacatcctgctgccatgtttctttctttagagctgaggagaggcctctttactttggtcggaaacctcattaggtttgatttagttcaataaaaatgtgtataggtgaaatagtccatacgaattcattacaattgatgtgaaacaaaattaattaataattaatccatgcaagtcttttggtagcctgcattttatcaaagaagggacccatggcaaaggctgggaagggacctttaacaggggagcatgagttccacggcagagttgccctcaagtaatgctttgtagattggtacagcacatgtgcatcaaagtagtgaaaggattatgaaatgtgaataaggagttagaaggtggaccttgaagtcctcctgggtacccatttccccaagagtgagcatcattattcttcattcccatacttctacaggatcaatgttgcagccacagtaggtggaaaattccaactctgctaacagttgggagcgtgtccctctaatgagaggacctgttcatgcaattttcttgatgtctggtgaacgctcccacattatatcttcaaaagactttactacctgagagggtttcatgctaactgctgagtaaaaccacccagtgctgagcacgcagagaagggagtggggatacaggtccaccacagcccaggctttggagtctgccaaagcagtcagacaacggtggtcagaaaaggtgtatgagtcactcgactgactacttaaatccaaaggaatttgtttacatggaccaatcgttttagtaagatggtttgttatgtgcctttataatttaacatattaattttatttagacaatattggaaaagataatgcaatccggtgatctcagcaaaattctctcctctataaaaataatgagaaaagtgacaaaaataatcagaatcaactttttagaactctggaaatttaccaaagtgttgcagccatccaaggattgtttgctcaagcaaaacaactgaatttcacctagaatagtgaggtttgtgacattttaacttgccccattcgcatcaccctttctccagcttcatggcagcctcgaaaaccagcagcccccagtcacagagaaaacccgtctagtggttctctgaaagaccccacttgcaaggctgtctttatttaatctgacttggagtttgcccagtgtgaaaagccatttcttcaggggcatttgttaaaaacatttagaggcaattgtttaacttcacagatgcttgagatagtggataatagttgcaacaaacaataggctaattaaaaagcttaaagtgaaaactggagaatggatgttcataggggctttgaaaagctctgacatattctgggaaatctggaaggccatgagcaggagtaagataggctttgcacatgcacagagctgtgtgcaggcttggaaaagatcttagaaggtcctaaaccctcgtcaatggctcccttaaagttctggacaagaagatattgtcaaaatctaagtttaaggtggaattgtcaactgcttggatgagtgtggaagacattccccaacatgcatgtagagcacctcagcaaaaacttggagatgtaaaccaaaaagaaaaatctaaggtcgtcctaccccaaccatctgaatggaaccctcctctctgtcaagggcattccaaagtttacctgaaaaagaagttcaggccatgatgggaaggcagagctggacaaacctggtaataccctcctcctttctggagttactaacagaacagactctaaatctgataagaaacatttacaatctagtctgtctgaagcctgctacctggaggcttcatttgcatgacaaaatcttggtttccacaacctcttatcataacccagatattcctttctattgatagtaactctttcaaccaattaccaatcagaaaacctttgaatccgcctatgatatggaaacccccacttccacttgtcccaccttcctggactgaaccaatatacatcttccatgtattgattgatgccttatgtctccctaaaatatgtcacaccaagttgttacccaaccactttgggcccatgttctcaggatctcctaaatgctgtgtcatgggccattggccactcatatttggctcagaataaatctcttcaaatattttacatagtataactctttttcattgacagagacttactagttcctgatccttaaagaaatttctctccaatcattagatgaccattaaactaacaaagcagagacgtcagtggctacacaagacaaagaatacagacttataacacaattacatcagaaaagttactaaaaaacaaaaacaccaacaaactgtaaaaacaacataacctgaggagtagagaaagaatctgattttttaaagttgccacattgcatttttaatgtccagttttaacagaaaattacaagacatgtaaggaaacaagaaaatatgtctcatacacaggacaaaatcgattaatagaaactgttccagaggaagcccagacataaaacttattagaaaaagtctttaaatttagttcaaagggttaaagaaaaccatatctaaataactaaaggaaaggatgaaaatggtgtttatctaacacagaatatcagtaaagagatagaaatgataaaaaaaaaaaagaatcaaataggaatgctagagttaaaaagataactaaaaggaaaattttaagaggagctcaacagcagatttgatcaggtggaagatataatcagcaatcttgaacattgttcatttgagattttccagactgagaaacagaaagaaaaaaaaattatgaagaaaaatgaacagaacctcagaaacctgtagatctctatgcttgtttttctcaggtttgtcaaagatcagatagttgtaggtaagcggcgttatttctgagggctctgttctgttccattgatctatatctctgttttggtaccagtaccatgctgttttggttactgtagccttgtagtgtagtttgaagtcagatagtgtgatgcctccagctttgttcttttggcttaggattgacttggcgatgcaggctcttttttggttccatatgaactttaaagtagttttttccaattctgtgaagaaagtcattggtagcttgacggggatggcattgaatctgtaaattaccttaggcagtatggccattttcacgatattgattcttccaacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgctcttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgcaagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctgggagaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacactttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcgaaggacatgaacagacacttctcaaaagaagacacttatgcagccaaaaaacacatgaaaaaatgctcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttttcaaaaaaaaaaaaattttgtctctaaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttctgaatcctttaagttgatcagttgacaggaatgcatttatgatttttatcttttcttttggggttacttttcagtttgactttgaaggatcactttcccctgtcattgcgcccaaaaaagccttccgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggttttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttcttttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccactgcacccggcccagttttttcttttatggttagttctttctgtatctagtccaagaatttttaatttagaataacacactgtattaagccttataaaaacaccagtaaattccaagacctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaattgtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtaaatttgtttgtaggttagaaactgccaggaagtcctgagatgactgtcttttccatgatatcatatagggaccttgtaaatacgtttctgaaatctgccttctctgaaaactatggcatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgccttacttacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatttttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgcttttttttttttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccatgcctggctaatttttctgtatttttattagagacgaggtttaatcgtgttacataggatggtcttgatctcctgacctcatgatccacccacctcggcctcccaaagtgctgggattacggcgtgagccactgcgccaggccgccaaggatgcttttaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttgggacccagttgttggaacagagctgaatcctggatgtttcttttgtttttttcacctttagggttagggcaaaatttttggttagattcttcttcttcttctttttttttttttttttttttgagacagggtctcactctgtcacccagatgggagtgcagtggtacgatcttggctcactgcatcctctgccttccaggctcaagcgattctcctgcctcagcctcccaagtgcctgggattgcctgggcttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtactgtggcagaaaacatgaagcattttggagaatatggaaaaacgttattccttttttttttttttttttttgagacacagtctcgctctgtctcttaggcatgatcttggctcactgcaacctccacctcctgggttcaagtgattcttctgcctcagtctcccaagtaggtgggactacgggtgcgcaccaccaggcccagctaattttttttcgtatttttagtagagacggggtttcaccatattggccaggctgttctttaactcctgacctcatgatccacctgcttgggcctcccaaagtactggggttacaggcgtgagccactgcacccggctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttcttctgtgtatagttctgtgaatttcagtacgtgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgtcatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttctggtttctaccttgtcttgtctcgtcattctcttaatacatcaaagagcaaaagtgtttaattttgatgaagctagtttatctgtatttttctttaatggatgttgcttttagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctggttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcctgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtctttgccccctgcccttctttttctttactctacgttttgctctgcttcatggtgagaagtgcttcagagtccccccatggctccaaaacagacatacagaatgatgattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagactttttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtaacatgtatcaaaattacattgttttaaaggcagtattctatatagtattccattgtatggatataccacaatttatcatttcacctgatgatgggcatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttacttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatgtggagcaaccgaaactctcatacattactggtgggactgcaaaagtggcacagcactttggaaaactgtttggcagtttcttgtgaagttaaacatacacttatataagacaaattccaactccttggtatttacttaagagaaatgaaaacatatgcctacataaagacccgcatgtatgtgaatgtctttggggccaggcgcggtggcataatctcagcactttgggaggccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcaacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagatgtgaatgaatctcaaagacttatgctaagttaaagaagtagcacaaaaaagactacgtatcatatgattcatttacatgatattgtaggatagacaaaactgtagagcaagaaaacagatgaattgtttccagtgctgggtgtaggaggaaaggattgactacaaaaggaacgagggagctttttggtatgatgaaagtatactatattgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcaagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcagtttctgatgaatcctcacagtatttaaccagaataactgtaggtaagttggtgcaatgttgcctctggaatcaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatgcatatgcaggttctgcagggccaattgcaggacttgagcatgcacggatttgggtacacatggggtgtcctaaccagtcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagaggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctcctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaattaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaagatgaggatattatatgggatgtatgttaaaaagtaaagttttaatgaatattaaaagatgtttttgaagtcttatctaaagtatgttctaaatgaagtttctgacaggttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctcttttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcatgaacccgggaggaggagcttgcagtgagccgagattacaccactgcagtccatcctgggtgacagagcaagactccatctcaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtactaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccactttgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtcccgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaacattaatctgtatttgaatgtgattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaaatagtgaaaactggctgggtgtggtggcgcatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaaaacaaaaaaaagcttaataatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagattttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatctcggctcactgcaacctctgcctcccgcattcaagtgattctccagcctcagcctccccagtagctgggactacaggtgtgcaccactgcgtctggctagctaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccatgcctgctttggaaaacatattttctctgtgctagtatagtcatggcacatcagcctatatatcctcatgttcagcaagtgcacgttaactgcttttgaaattattattataataaatctgttactcaggtgctctcatcagatgttccttcaggtacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaactttaacaaaccacgtgtgttagcaaaatgtctttggcttttgaggacataattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccttgatacattataagactcacgtgcctatgacattccagagctattctcttgggacacttctgttttaaaattctctcctgttcttttatctgcttgtctctatcatctatcattcatctgtcactgttttctagttctctttactttttttatggtactgttttgaggggaaccatcacccacacttagccacaggctgctgaagatctgaattagttgtgatttccctattaactgtttcctctccacatgtacccagttattagtcacctgtgaataaaaagatggagtgacagaagttgagtttagagcataggatttatgagcatggcctctagagccaggcatggccatgctgtgctgggtgactttggttaaattactttacctcttgttgcctcagtttcttcatttgtaaaagtaggcatacttcatgggatggtgctgtgtatcaagtgaattatttttacatagcacttagaatactgctcaatacatagtaaagctcagtgcagtcagccattattattagtagagttcattgattctaagatgcaagttttttcactttttaatatctctgaaatcagttgtgtattttagtgaacaggcgtcatagtttaattggcagtgctttttctttcttagtttctcatgaaataatgatacatcttatcagtggcatcttatattcaggggatataatattgttctcattataattttgttacttgcgcaaagttgaagtgaattatgtgtaagatttcctctaaaaaaattctatgggttgcaacagactcttggctttgaattttcctgatcccaaattaatgttgcggttgtgttcccagagaatctttaagacagcaaaatttttctttccagttagctagaaaagcagttatgtgtgtccagttaaggagggagtatgcttatgaatagctttgtctgcagagaaaatgtttgtcagttgtcagcctctgaagggatatttctgtgtcttcagatatagcttgtataggtgtttcttagttataaatgccctacttccaaaatttctgttagttttttttaagtggctatatggaatgttaagctattttaacataggaagaagttgaagagtggtgtatgaatttcacagtagagccaacagaaaccattttaaccttgaacatacctgatacataatggtattagtcctataaatctagccatcatgtaagtgaaaccaatctgtatttcccttggagacaccatgaaatccattcacctctaacacaaggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttttttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttatacagtacaccttcttttgaaatacttacagatgatatttcaattgctctttgctttaaacattttcacatgttggtttttactttaattacagattgctccaattgtgtcagcgaactatggctcttcctgtaggacgaggaatgtttaccttgttttcgtaccatcctgttccaacagagccattgcctattcctaaattgaatctgactggtatgttaaattctgggctcaatgagaaaggaaaatgattaagtacatgcattaagtgtagttctttaaattagttaaaacaaaagaaatgctccctctatccccagtgatttaaaattttcctaatagctgctgtagtggttatcaaagctcaaatgccatgtgaaactaaactttgagagaagcagaatatagttcattactcatttttgctttttaatgaggtgatttcaagatctaaaaagtcacttggagaagttcagaaagatattattgataacgatgagacttgaattttaaataatcttaagtttaatatgtaaaaatatttagttttaaaatgtcttacgtcatagtttaaacagatgatcattgtataaatcaagaaatgtactaagcaaaaagagaaacaatggtcacttgcagtactcccactcttctgcatcactccttttaacattttagtatatatgtttactaagtttatttccacatatttataattttatatttgtttaattatcagaaaatttatatctattttagatttttttaaaaatttacagtgaacatccttttatatctagcaaataaatgtatgtgtttataattatgtgtatgtattgtatacatgtgtttttaatcaatacactcatttttatttgcttcagagtatttcattcagcggatataccatagtttatagaagcagcctggtattgttggaaattacagttttttggtattataaacattgttggggcgtattcgtcctgtgtatttaggctaaatgcttagaagtagaactcttaggacagcaagatgaatggttttaaggaacatgtcaaattgcctttctggctggcacaagtttttatttctgccatatataactgtagttatagtcttgattacaatgaattttatagtgcatgtccccctaatgctgatttgaatgtgttctaaaggtgacaattacatagttgaaattatcactgaaactctattatagtatatatggttttgtgaaacctatacaaaatgtatgtataatgtttgttgtagtagtgtatagtatatgtggtagcatataatgtataatttaatatatgataaatagtacataatatatgcaaacataattatacagtattttaaattgcatactttaaaaaatccagagttccactcagatttgtgaaaagcttgtgctttgagcagcatgcaggaaatgagattgactaagtgaaagaacacattcccatctccataccatgcttattctgagccctaatctcactgagggacatagtgagcagagtggcttttaatatttaaattgtctcagaggtaaagcacctatggcaaaattttaacaattattgattcttgatggaaggcatggtatatagatgttcattttagtagtctttccaactgtttatatgaaagatttcatatactaagtgcagattaaaaagaaaatctaatgcaaaattggcaaatgttaaaatgtattcaatctgggtgatttagcactcaagtgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtctcttgcatatgatgaatgaatgtttcagaaaggtcactcagttttttcatattgatatgtctgccttttttgagaaagtacaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactttgcatctacttaaaattattttacataacatcttagaactctttaaaaatggtatttttaaagctgcagtgaaatggataactttatgcagtaattaaaatatttatgttaattattttatccgtgacttaagacaatattcaaaatatatttaaaaagattcaatgtttgctgtgtataatgtagatcaaaaagaaaagaatcaagaaaaaattcgtagggaacatatagcattgtgaacatataatttacattgttcttaaataaatggaccgtaaaagtataatctggtgaatgcccttttgaagttcactgggtgactcaagtctataaaaggatgctttttacaaaactatctctaagcattttaaacaatagcatataattagatatctatatctgtatgtatatatagagagagagagaaaaaaagagagcaaagggggcatatataggtaagacctgtagcagatttattaaggttcttgtttcctttttttttttcttttttgagatgcagtctctgtctgctgcccaggtgggagtgcaatggcatgatcttggctcactgcaacctctgccttccaggttcaagtgattctcttgattctctttagaaagtgataatctttctaaagcataaatcagagtacgtcacttccctggtcaaagccatttaattaatgatctcccattgctttttttttttttttttttttccttgagtaaggcagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaaccttagcctcccaagtagctgggacaggcacgcaccaccaggcctggcttttgtcttttcttaagatgtcatttttccttaatgtctaggggaaaataaaggatagaacatttgaaattaacatcagtgtcatcagatgttgggatttataacttgtatagtttaacagtgatgttagtcttcattttggtttttaagctctctgtttgaaagaaaaaatgagtgattatcccagtcatctctgtataatgttaaattggtatcagttatctcattatatagcctcatacattttaacaaaaaggacaatgaactgtttagacagtgaaggtttttccagttccattaagtttgactcacatgtacaaaagttttaagtggtcatagagacctaacgttccaggcattatggggttaatggttttgaatgtagaaaacgtaactaatcttagtctcaaagatctaaatttaacaatcttggttttgtggatttttattctctcaatgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaaggtgagacctgtgctcccagtgcctggctttgtgccttggctggctattgtagtagctcctaattgctctatttgctcttctttcttcattcttgtacttctaagtccatttgtctcatagtacatggaataatctttctaaagcataaatcagagtatgtcacttccctggtcaaagccatttaattaatgatctcccattgctttttttttttttttttttccctgagtaaggtagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgctttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatcttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccagggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaacattcccaacaccagagggcaaagggggatcgaccattgctcttaatatacattctaggagctggtgtgatcctgttcacttctccagccctaggtggtaccactgttcttcgttttttttttttgttttttttttgatgtggagtctcaccctgtcacctaggctggagtgcagtggtgtgatctcatctcactgcaacctctacctcccaggttcaagcaattctcctgcctcagccttctgagtagctgggattacaggtgcatactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttatttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctgtgggtttgccttttctggacctttcatatgaacggagtcatacaaaatatggtattttaggatgggcttctttcacttagcctgataattttagggttcatccgtgttgtaccatctatcagcaatacattcctttttattgttgaataaatgttttattttatgaatgtacattttattcataagttgatgaatatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaaccgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcttgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaaagtgatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatcctgctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattggctccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaataaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaattttttttttttttttgagagtcttgctctgttgcccagcctggagtacagtggtgcaatcttggctcattgcaagctccgcctcccgggttcacgccattctcctgcctcagccttccgagtagctgggactacaggcgcccgccactacgcctggctaattattttgtatttttagtagagacagggtttcatggtgttagccaggatagtctggatctcctgacctcgtgatccacctgtctcagcctcccaaagtgctgggattacaggcgtgagccaccgtgcccagcctaaaaattgtttttatagatcattgttataaatgggttttaaaacacattttgtataatattcattgagttgatggtctgtaaaatgcctttttttaacttttagaaccttttagattgtttctaataatcctttgttgttatgtataaacattacactgattacctttgtgtgtgatttttttctttaatttttattatttatttatttatttagagacagagtctcgctctgtcacccaggctggagcggagtggcgcgatctcggttcactgcagcctctgcctcccaggttcaagcaattctcctgcctcagcctaccaagtagctgggattacaggtgtctgtcagcatgcctggctaatttttgtagttttagtagagatgggatttctccatgtcagacaggctggtctcgaactcgttgacctcaagtgatccacctgccttggcctcccaaagtgctgggattacaggcaagggccaccacgcccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacatagtatttaacagcttaacaacgtaagtaagtgacctccttattcattatcatcattcgaacatgtttcaccacatgtgatgtgtggatttgaaagtaatgaaaacaaaatgtaagatattttgttgttgttgttgctgagatggtgtctcactctgtcgcccaggctggagtgcagtgacctgattttggctcactgcaacctccgcctcccaggttcaagcgattctcctgcctcagcctcctgagtagctgggattacaggcacctgccaccctggctaatttttgtatttttagtagagacagggtttcaccgtgttggccatctggtctccaactcctgacctcaagtgatccacctgcctcagcctcccaaagtgctgggattacaggcatgagccagcacacctggccgagatgttttaaaaaaaataataaaacttttttttgaatactcttaccttttttcctttaaaatttttttctactacttggtaatttttttgataagactcaaagtttcacagtatttcaatatcattgcttataaagacttaaattggcaatttaaaaagaactattttgggccctttttttttggtaggtaaacctacagttgtggacatcatttattatagtgtcataactttctgaatagttatatcccattcatatctccagtgcaacttgctagaaagttaactctaagatttttatgagatgagattttgagaagctagtttgaactgtgttgcttttctttttacaggacggcctcctggtcctgaaatggaatactgcactgacagaaagtcatactccttagctgctggcttggccctgggcatggtctgcttgggggtaagcatagcctatgccttcccatgcttcagttaggacatctacatgttgagacaaataacgttgacacctaaacctgaatattgtcccttactacgacttaatcttctgcccagctctcttgtctttttggatatttttcaaggtaccagatttgcaaattgagagaaactgtggtcaagagtgagactttaagatttcttttcctccagcttacagtgttcatgaacaaactaaagggaataaagttttttttaaagtgttcaagacatagaatgaataagtgacagcccactatgactgaaaacagagaatagtgaaaatgtatatgatcaggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagatcaggggttcgagaccaacctgaccaacatggagaaaccccatctctactaaaaatacagaattagccaggtgtggtggcgcatgcctgtaatcccagctactcgggaggctgaggcaggacaatcgcttgaacccaggaggcagaggttgtgatgaatcaagatcacaccattgcactccagcctgggcaacaagagtgagactccatcttaaaaaaaaaagttatagtggaaggaattttttctcatgtgtgttctgaaaatccacctcgtggttgaccatctgttagggccttgaattcacattggcacgtgagctaaagaggctggtggtataatggaaaataatcagctgggtgtggtggctcatgcctgtaatcccagcactttgggaggccgagatgggtggatcacgaggtcaggagatccagaccatcctgtctaacacggtgaaaccccgtctctactaaaaatacaaaaaaattagccaggcatggtggtgggcgcttgtagttccagctactcgggaggctgaggcaggagaatggtgtgaacccaggaggcggagcttgcagagagtcgagatcgtgccactgcactccagcctgggcaagaaggcgagactccgtctcaaaaaaaaaaaaaaaagaaaagaatcacacagggaattgcaacttgaattctggtcctaactagtgagtcaagtcatttaactacattattgtctattgcttaatcagcttcatggattgttgaaccagatggccgtgttttatatatagccctgcaacttactataatagctgtataaccttgggcttaatccctctttgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgaaagtattcagatatttacagttcaggtttcaattatataactaatatttttctttattgttaaatgtaactaactctaaagctcttatgtattttaagacagtacttaaagttgaacattcatgtattaaaacttttatgagaattattaatatttattaactcatgattaatgtttgctttaagttggaaataaaaaaaacaaaacccgaaataacctgctttgaagttagttcatttttatatttgttatgggtatgtgttatggatcttcctccataaaatttcttttcactcgtctgttattgtcttttccagcatggcagcaatttgataggtatgtctgatctcaatgtgcctgagcagctctatcagtacatggttggaggacataggcgctttcaaacaggaatgcatagggagaaacataaatcaccaagttatcaaatcaaagtaagtacacagcaaagtaatagatcaaaagtctggaagctgggaagttaattggaaaatactagtgttcatcctgacattggtaaatatgttaattttaagcatacttatcagaggaattttataaaaatttagaactcttttacatgcataaactcttctttcaataggaaggagataccataaatgtggatgtgacttgtccaggtgctactctagctttggctatgatctacttaaaaaccaataacaggtatttctacccactcacccttcctcccacggtgatagtgtgatatcctctctgaccttggttgtaaaattcagttatctcatgtgtttctttcccctgtgctggattaagctgattttcgttctttcaagtactgtaagtttttgaaagaaaactggcagtatttgaagttataaagattttacctagaaataatgtatttggctattttaattgtatttgacaatatagttttcaatttctgttcatttctgttttgtagttgatgtcagtaacacccaaacaatgcccatgtttgttttcattaatttagcatattgctgtgaggactggttaagccagaaatacttatcattagtgtgatcttggctaccatgtaaaacaatggtttttgcctacttcaagagcttttgtaattaccaaaccgtctaccttcctaacttgctatattaatgctgatgcttgaaagtaagatctttggcatttatgcttacacgttgcatgaagagtaagttgagtacaacatgttatgccatgtattaagtctattaattaaaaacaaattctaagattcaaggagcttttcagtgttccacatttctccctttagaaaaagtaaatgtgtgcagaattaacaaagtgtttaaaaatagatatttattattttactatttggatgaatgtgtagggcagtgcttccttggcactggggatatttcattgagcaaaactaaaaatatcttccctcatggagtttatgttatagtaagacatacgtgtacctctataataactattacgttagaaggtataaagtattgtgaaaaatatatagagcagtagtggagtgggaagaaatgttttgaaatagagcttgagattcttgattgtcttgccctctacttgaacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaagccactgtgttttggtttgattcatcccatagcaaaaggcaacttcagcaggccctttctgaggctctggaggggccctggcaatgtatccatttggtcatttgcttttgacaaaagcagacattttagctgtaattggctaaaattctgatctctttctgccctcatgttgggtggtggtggagtggatgtgggcattttgaggatccagcaaaagaagaattgagttgagtcattgagtttgggttccatgggatttatttatgtggtatggagtcatttctgtgtattttattgctagctgtccctgtgtaaaacagattcagaatagtcttcacctccctcgtgctgatttacctggtggtgtaatgtaaatatgcaagaccatagattacatcacgattgtgtcacatgacatgtgcatttgcaggaacatggatggagctggaggccattattctcagcaaactaacacaagaacagaaaaccaaatatcgcatgttctcacttataagtgggagctaaatgatgagaacacatggacacatcgaggggaacaacacacactggggcccatcagggttggaggatgggaagagagacagcatcaggaaaaataactaatgagtactaggcttaatacctgggtgatgaaataatctgcacaacaaacccccatgacacatgtttacctatgtaacaaccctgcacttttatccctgaacttaaaataaaagttgaataagaaaaatagaaatgtacaaagctagaaaagagtgtagctcatcccatctgggaattattccaaatcttacagttcatacataaaaatagtttgataaagattttcctaagtgtgccaagaatcctgaaaacttatcttccattatcgatcctgagctatgaagccagaagaaaaatttaaatctatcaataataaaatactagagccaaaatagtttattattctcttctctcatagactatgatattacaacattattgaagaggcaatcaaagaatatgcaggcaaaaatgttgggaaaggagtattacagagataggtcaggaatttgtttaattaaaattgctattttactgagttttacatatgtttagtggtagcggtagctagagtagactttgctggagtctgggccattgagattggtattattaaggttatgttggcctcatttgctcttaccttctggcatacacaggatacatctcacttgatttctcacaagtctttggtacccatgaccactcccacctttttacaattttcacttttgctggcttctctggactcacactgtcaattttcccctctggctaactgttctcagtcatctctacagaattctcttcttctgggtccttgtgttgttgagggctttatcctagggcttatttttttctctctgagcaagcttgtccacccccattgcttcagtcccacctatctgctgacaactgctgattccacatctccagctcagacctctttcctaggctctacaccaggaattggcaaactttttctgtaaagcgatgataacaaatattttatcggcttgctggtcattgtactgtctctgtcacatctgctcaactctgctaaggtggtgcaaatatagccacagaaaatagtaaaagaatgggtgtggccatgttccaataaaacttgatttataaaaataagcctgcttcatgggctatagtttgccaactcctgttctaaaccagaatattcaactcccttctggaaatttccacttgggttttctcaagttcctaaacataacattgtccccagccaatttcatcttattccctcctatgcattccttcttaatgaatgatccactgtccaccagatgtccaagccagaaattcaggcagcatacttgatttcattccccacattcaatgagtcacaaaatcatgtcaattctactttctcaacatccccctaatccattcttttttctctttctccactgccttctttcaccccctctcatctctcacctcctatgacctcctcactgtgctgcaatcagagggatcaagccacccttggattttaaaagccttcagtaacagtagtccctgcctttctttggctgaagtctaaacttcttgaaacagagtgagaagcctgcgcaattggaccatttccccatgttagccaaattcctctcatctgtctgctcctcctgcctctgggaccctgcacatatatttcttctgcttaaagaatgtgtagcaggtgaagcaactatctgaggccagtataccatgggcagtaagaagaatttaccaagacagttgtagataaaggcagatttattgaagaaagtatgaaaatatgttgcaaggcagcaacaggcaggccagcaagagaggaactgaatgccaagagacaaaggcttgctgggggttttataggatgttgcttttgctgcgtgctgaagagagctttgtgcagtactgataacaccaaggttgcagtgggataacctgcatttttccatcagctgagggcctgatggtagctgggcacaggaagattgtgagctatttgtgcaggagggctatggtcctggaccatgaagaaaggcaaacttacagcttatctgctttctctttcttttttcctcagtgtcaccagcctgattccttttgcctaattaggactccacagaattattctcctttctcatccttccagctgtcttctaagtctcaacttggatgttacttcctctgggaaatgtctcctcacctctcaagactgtctctctgtgcaccactacaacaaatgggacctgggccacttcacttttacaattccagtttacagacctgcattgccccaaacccatgagaccaaaaactccctgagggcaaagatggcctcttatttactcttgattccccagcacctagcacagcactaaacactgtacccactgaaagaacatctgaaggatgagagtttatagcaaaagtggtttccactgacattcccttctctcttccccaactttggattgaggagcccaggagctggtcaggtggcaagataagatgagaaaggagaagtcattacttggggcctctgttttgctggtgttttgctggtgtgtggagatggtgggtttcccttgaatacctgggaggcaggagcaggcatgaactactccagcctctgggttctggacccacatggagggctgctgctctctggcacccatcagtccttaaccatctggtctccagccagggaaggagtgtggtggtggagaagcctctctgtcccacccactcatcccaggagctcacgagaatcagccaaagtccgagttctgcaccctgagttaggaactctataactttagactttccctgaaatttgggaattctcttaactagtatgaaagcagttacatcatcctaggtcctcctaaaatagacacatgtatccaaatataggcacatgtgttgcaaacataacatgtatacatatataaatatatacatataatttttgttttgaaataagtataaacacaacaagttacaaatatagtactgagagatccttgtgcctatggccccgcctccctcaggcagtatcttacataactatagttcatgattacaactggaaagttgccattggcacaatatcagaaactagtctgcagaccttgctcagatttcaccaggttttttgtgcactcatttgctttcctgaaaatattttaaggtttttctacatgacttatctccctgacatactgtgagataagattttttttttctctgaatgagcttagagaacaatcaatgtgagagatgggaaggatgatttggtgcaactctgttttatccatggtgagtctggacctcagagcagaaggaccctcgtctctcctctggggagtcctggtgccacctcagtgcaggctgctaagttatccgggtctgactttcttcttctctgctaatatttgtcttaagcatgtaacacagccatgcttattaatgatgaggagacagccaatgaaaattaattttttcaaagatgaatagatatctagattttttcaagcacaactcaattaagaaaatatcacctcactgagccccaaatgagttaggtctcactgagaaagtgtctcctagtgccaggcaaagtgcctcatatttgtaatcccagcacttctggagactgagataggaggatctcatgagcccaggagttcaagaccagcctgggtaacatggcaaaaccctgtccctacagaaaatacaaaaaaaaaaaaaaaaaaaatagctgtgcatggtggcgtgcacctgtggtcccagctactctggagtctgaggtgggagaatcgcttgaatccaggaggttaaggctacagtgagctgtgtttgtaccaccgcactccagcctgggtgacagagccagcctctgtttccaaaaaaaaaaaaaaaaagaaagaaagaaagaaaggaaaggaaaatgccccctagtggattacgttttaaccactgtgctaacttgagagatagcctgctatctctttacgggacatgagggctgataagcacctcattgcatggtcctggggactgatgaacaaaggctaacatgtggaaaagagcaactaaagaaagaagagccacctccaggttaattagtagaagtctcctcgctgatatgctctcatacactaaaacagcagtaaaaacaacctgcacattggcatcgagggcacagataaacttgccgaggacccttaccacgacagagggatgctttatatgaatccttagtagattaattaagttcttgctatttccagttggaaatgatactgtcctcttagggctattcagagaagttcatcttgatgaagtgagctgtcctagaatggcagttcccgggcagcagagcctgggctcaaggaaggtggaaagagggggtggcgaggagctgccaggtgcaaatgtcaggccagcaatgcagtccagcttgcatggacgtgcatcacctaggaagttgtgacttggctgcattttccacttcaggtgagatggaagggtgaactctacctcacctcctggtgaggttgatgtttcctggtgtttataactttctttgtaaatacttgcaaggaatttaccattttaatgctggaagagacgtctattccttcataagaggacctgagtggatcttgattgcaggccttatgctgggcagagctaaggaaattcaatttgtctccaatcttatttgaatgttctttttttttttttttttttttttgagacagagtcttgctctctcacccaggctggagtgcaatggcacgatctcggctcactgcaacctctgcctgctgggttcaagcaattctcctgcctcagcctccccagtatctgggactacaggagcatgccaccatgcccggctaattttttgtatttttagtagagatggggtttcaccatgctggccaggctggtctcgaactcctgacctcgtgatccacccgtcttggcctcccaaaatgctgggattacgggcattagccaccgcgcccggcctatttgaacgttcttatgcctgctacaagtgcagcagcagaatctccacacatcttgagtgcgaaagtttcctgtagttcctttagcatggagaggctggggaaggttacagactgatttgtactctttagacatatagttgatcattgaacaacacacgtctgaactgttacacacagatttttttcaataaatgtgttagaaaatgttttggagttttgcaacaatttgaaaaaactcaaagacaaaccatgcagctagaaatatcaacaaaaatagaaaaagttaagtatgtcatgaatgcataaaatgtatgtagatacctagtctattttattatttactaccataaaatataacaaaactattgcaaaagttaaaatttagtaaaacttatgtacacactcacagatcgtatatggtgctattctcagttgagagaagtgtatacaaacatcaagatgcagtattaaattgtaactgcataaatttaaccgtagtgcataccacagtacggtaataagttcatagcctcctcctgttgctgttgcaatgagctcaggtgttgcaagtatccacttaaaacgttctgtgatactcaacattccatcatgagcaggtcatccccagtgaattgcgcatcccagtaaaaagtgccctctccctgttcacgtgtatttttcatcctgtttcgcgctgtactgtaaaccttgaataacaccatgggatccacatgaagtggcactagtgatgctggaagtgctcccaacaagcagagaaaagtcatgacatttgacattacaagaaaaacttgatttgcttgatatgtaacagagactgaggtctgtagctggggttgcttccatttcagacagatgattcatcttgtaaacaggcggtgtaaacttactgtatggataaatacataacagtaccatagatgtattttctccttagaaacgtttccttttctctagcttactttattgtaagaatacagtatataatacatataacatacaaaatacatgttattaactgttgctggtcaacagcaggctatcagtagttaagtttgggggaatcagaattatacctggattttctactgtgtacggtcagtgtgccaagcccccaagttgttcaagggtcaactgtaatcctaaaagaatctaatacaatattgtacacagtaagtggtcagtaaataaggaattgaactaaataagaatacataaatctcagaatatgtgcaacctgatcgtagtacacagagatctctctatatctcttttctcagttcatgccattatttcaggtagaaagcaccttattttgaattagttgtctttagagcaaaaatccgtctaagagtgcagtgtggtttcctatgcacaatctggaatagtccattgcttcatgcctaccctggacatgaagggccgtgccacagtggaagtctctatgcatccacccctgtctatacctgagcaactcattcctctttgctgctctcttacaggctacagagtgcggtggcgccagcacagaactctgctcaatgtccctctgtgctttcacgatgctgatggattatgaaggtagggaagaatgtacagccaggaggccattaggagggcaactaatttataaaatcgcatttgtagaatttaatgcatccaacacctaccaggggaaaggtgggcaaaagctataccaacaccacccaagtcaaaaccaaaacaacaggaaaagaaaattatgtggatgtagaatttctgataacatcattcccaagatgccttatccaagaggaactgctacaataatattttaagtggaaataaatacatgctggaagcattatatattagtagactttgtttttttttttccccaaagtactttctcaagcacatcaacataagccccctaagagacatttcacattaaaaataaaacgtctgcccactgctggtttctcaatttgcctccaccttctgtcccctttaatgaactgggccacgaggtgagtcagagaggataaagggagtggtaagaatttgaggagagaagagagtgaggctagaataggaaatcaggaaatgcgattcggtccccctgttcctcacatggggccaccctcttgttgcccagtgtggtttcttcttgagggttctgcatgattcctcaatcccagggaattccacaggatgttccacccaagaccattgggctcccacctctactcttttgccagttaatgaataggcaggaatttcactgcctggaaagaggaacaatgctttctggtccttatttcacatctaaaatagagaggtcaattgatttattgctaaatatctttgaacactaaaatagaagttttacaacatatatactacctggttgctctagacttaagccagggaaaagtacagattcaacatttaaaattgagatagacgctttccacttagtgctaccagtcttgctttatttcatgagaatgagaatataataatatgccatacgttcatttgggggaaagattgatgtcttataatttataattacagaaaacatgtgagttcactgggaataaagaaattttgaagataataagatactttcacttatgtcgtaatttctatgtcatttggtgtaggatgtggagatattaacatttacacctaacttaagtttgtcatccaggacctgaaagggttttgtctatcagctgcacccctgggtagcgacacaaccttggggaaggcctcagccccatccctcgtacagcaggaatgagaacagcactgcctgttgggaagcttgagggaggctatggacgtgcagcgcttggcagagggtctcgtcatggaaggttccagcaaatgtgagatacttttctgatttcattttctccaaaagaaagggaataaaagaagaggggaggaaataagactaattgtgagagataaagtacaaaggtgagggaaggagtaaggagacatgaaggcagcgtggagcagctgaggggggagattgctttcaccacttcccagcatctattgcagattccaccctcaatcattttgtaaggaccctttattcaaggtcatgtttgaaccctgctgagccagtggcgtgggtgtctgagagaatcattaacttaatttgactatctggtctgtggatgcgtttactctcatgtaagtcaacaacatcctgggattgggacacactttctgggcactgctggccagtcccaaaatggaacataaggaagtggttcttctacttcttttatttctgaaatcaggtaagacatagtttttttaaattataataattattttttctcccacaatgcagtacaaatacatatgccatggctttatgtgcaattcatttaatttttgattcatgaaactcccagttgaaaatcttgtataagattgaggaattcttcaagaaataagtttagttttcctgtgaagattgtcagcgtgctggaatgaatgcgcagagaaaataatgggtggtttttcaaatctaaatgagtgcacccacataatggccagtctaattgaaaaagagccaatgtagctaactatgcaaaggacggctaagctcttcgcctggttctcagtttgactaatttatataatctctcttacggtgtcatgctcccctcacttgcaagttaaaacaatgaaatttctctttgaatatattctgttctctcaccagttcatggtggtggcagcgtcagggattcagcatttctccctttgttatggcctgaggaaggctttccatcagtatacgtttgcctctaatccccggaaaaatcacacgcatccatttgccagatgctgtgtgcagacagtgattcaacaaatactcacttagtgcttgggttaggtcgctacatttttacacatacatacatacctgtgtgtgaatgtgagtgtgagtgtgtgtcctttacaaatactagcttatttagctcgcggtataggtagggtagcatattcaccctcattttataaacaaagaaatctagacaggaaaatcatgttatttgctcagtgaccaaattctcaaatctgggaaataaagaaaactggatttaagccaggtttcccagaaggaatctagggctcttctcacttttcagctttgtttaagcctttgaaataatattctaaacatgtcctagtagttctttttctttttctttttttaaaaaaaagctttatggagatataattaatgtatagaattcacccatttaggcatacaatccaatggatttcaatatattgagagttgtgcagccaccatcagaataaattttaaaactattcatacccccaaaaacgcactccactctccttagctgttacccccgatctgcagcttctggcaaccactaatctactttctgtatttatatctttgccattttgaacatttcatacgaacggaatcatacgatttgctagtagttcttcctgtaaataatgtatacttgaaattcaatctataaattaccagataaaattttacaagttgcactttagagtcaaatacatttgaatttagtggaagccattcaaggagctatcaaacaaaatacagagcaggagaaaattaaagaaatttttgtaagaaattggtgtatgttgggggtgtgaatattatatttcaatgcatggaaactatgacatagatcactgtgaacttattcagtgggctacacccaaaggctagaacaaacttctccgccacaggattaccaatgttttaaccaacctggggggaacattctctcataagctcttttggaaagccaggctttctgtggatgtatcatctttccagtgtgctgcaatgcccggggagaggaaaaagtttcttttacagccatgcttagtgggaagtggagaaacatcttccatttcacaaattaagtcttttacacatgcaaatatgcatacacattcacacaccacagtgaggaagaaattctcacaccattaataaaatacatttgcatcagtagcaatatacatctgcattttgcctataatataaatgtatttttccactaaaagatttgatgtttccttgccagcaaataagccctatcaaatcctattgccatatgagtcctagaggtgaataagagaaaaaaaaaatgggggaaaattatttcaaattaaaaagaaaaaagtttgattctgttttgggatatttcctagggacaggagctggggaggggatctcagcagcgatgcgctatgaagtataataacatgacacagagaacttaattgaagggggaaataaatggaagttttctttttttgaatatcaattgtagcctgctctgctatacttcaaaaaaactcttcagaaagtttaactgaactcaccgtaggacacactttgtggatttattgtgtgttttgaagtcacactgcgagctatagaattaaccaaaacacaactcttcttggaaatgagagttcaagttggcagaaagtgcggggtaaagacatggatatgggcctaaagcatctatttctttgtgatcttttgatacatctctcaagtgcttttcagtggattaggtttagaatgcatcagccaactcctgctcaataatccatttttccagcccggaatgtcttaaattgaggaaggacgaagtcccagaggtggggagcagggggactttggccgaggactttgcatgaattgatgagcgtgcatcctcctccctgtgctctgtgtaccctcaggaggtcaggacgggcctttctgagaatgagaatctgttcatttgccttcctactggatatttgtcatcagcatacaaaccagtgcgctctgcagtgtgtcatctttcagaacctcccctgacctcatcttccctggagggctcgctgtcttcagagccaggcttgtctcccgctgccgcctccactgctctcctcgtcactctataacccactccctctgcctgcagcccccaccacgcccctcaaagtggtcaaggttgtcctgttgtctaattccatggagcttggctatcttcattttattagcctcttttggcctcttacccctgtgaaaatcactagcattctgtgcgaaggatggagctggcatctccaggcttggaatagacctaccaaagctcagccagatgtccggaagagcctcaggacaagggaacaccctgtagccttgtggtgggagcacagctgaggcccccttggccaccctctgccacgaccaggcagaaagcagctttcggacagattcgttgtctcagatttgatctcaaagaaaaaccaagaccagtatttgtcccaggttctgcttttttacaatttcctccgaaatccagatacctgtcaacaccttggaaaaactgatttctccccagttagtagtgttgtgtgactgtcatcagcccagtacaaaaatggccttctttgttggggagcttcttaccctccagtgttttgcccaatttttgtccaagttggcaacataatttagttcagttcttgtttatttccaccatcatctatgcaccaaaatttatgtgtctcaaggagggaccattcagaggatgcttcccaccagttcaagtgacagtgtcagaaccaaagcgcatattgtaggaaatcaaacaatggcctccaagttccatttctacccagggatgaacaaatcaacatcaatcttggtaacacaactgccactgatggtgccttactcttctctcatgacatggcacaattgatagcaaacataaaatttgttcttgtttaaggatttatatccactaatatggtaacatagtagtggttccatagttctaacctgtttatcaatccagttaatcttttactatcttgcaatctgttaatgaaactgtttttctttgttttataatttcaacttttagagtcaggggtacatgtgcaggtttgttacatcactaaattgcgtgacactgagctttggggtacaaatgattcccatcacccaggtagtgagctaaatacctactaaataggtagtttttcagcccttgcctcgctccctctctcccttctctggtagtccccagtgtctttagttgccatctttatttatgtccacatgcccaactgtgtgttcttaactaaacattttgattcatagctacccattctacttccagtaaacagcaagttttatttggttaatgctaaccaaatagattaaaaggaagtcatgacaattagacattggcattgatttactgaccatttattccacttggatctcccacctctaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcaggtattttcatcgtcgttgcacctacccagaaatctgtaattcagatggcaagtaatttactcacaaatttattaacgatttaagaggaaagagaaatttatggagccagagtttggaactatatttgctcatagcatgtgaagccatactaacagcttcttgttaaggtttactggagtcttcattagaaaaataccctaaaaggaagttatttgtttttacaccggacataaacattagcagttattgttctgagctccagtttttaacatcatcatcagtaaatgtttgttgaggatcatatgaatgaaagtgtcctagatagatctgagcaatgacttatagctacaagatccagtgcctgcccttcagtatttaaggtgactggatataatgttaaaaaaaaaaaaagacagcctaagtgagctacaggcataatcaatgcatgttctacccagatccagaagaaagaacagtgcctaaggttgaggcagctagagaaggctcagggaggaggtgggaaccgagctgggtttggagttgagagagctcttgaaaagcaccaggaaggcaggggaagatgcggccctgcactttctgagggggaccattaagagatcaagttgactaaagcagagactttgtgtaggtgatgagcctgggaaagtagctatggatgccagactgagcacccatagcaggaccacgggatggagatgggaggggtcaggggccagggtggggtggaatgtggggcagaggttcaggggaactgatcagagttgggaggtcatggagatggactatcttggggaatgggttcaaagcaaccagagttgcttctttctgacccaaaaacaaaaattaagaagatgagtgaagaagaagtaaaacagttgaaacagaaagaaagagaaaattatgagggagggaaggtaagggcagataagatttactgccacgttggtgtattttgttcagtacttcatcaatgccatgcccaaataactgaaagaggcagcaattctgagctctctggtccctcaagatagtcaatgatctttagcatttctcatttattaataaacatttgttttctttaaataaagaaaaatacttattggatttcctgcttcgttctgcagggcattccaatatcacagtaaagagcaacaatgtgtgataatggctgaaaacaggaagtcctccataatcattaggatgagagatgcagttttatttgaaaagtaaagtgagtacattttcttcctcctcctcctactgtcctccccatcctcccactcttcctctttctctattctatctttaatttatgagaccagaggaggaaggcgctatggtgttgtaaaattgaattctgagttaggacaggatttgattactaactaaccatgtcagcttgagtatattacttcacctcctagatttaatttttttttgttcaaaaaatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggacgaagccttgtaaaacagaaatactgaggtgttttaatcctcagaaacatttagattgggacacaaatcttattttttactcttaaatttttcacattttgggggacatggtctatatttttctcagatttctgatatgttgtcttttaaaaatgtgtaaaagttacagttccttttctatagtttattttaaaatgtgggtcaatagtcccactgcttagaataagaggcacacaggatttcaatagaaattgcatgcctttttagatgtgcgaatgtttcattaagcgtatgaatatttgaagagatgtatgacactttaaaaactgtttcctctactgtgttggtggccaggtattaagactgttaataataacaatttagctctccaaatatcctgcatcacaggtgttaaagaggactggaaacaccttagttcttgtattcttgaggatgatttgccatattgtgtctagtatcacggcaaaactccaagtagcattttaaatagtatttatttgggttggaattatttctatgcattgactcatcttcctgggtttcattagctgtacgcattgtactttcttccttaccactatttatctcgaattcttgagattaaagtacagatgaaatctaaactttatctggtaaagttattagttcttacaagtagcaagcaaacggtaaactaaataggatgacctaattgtaccagatttaaaaaaaaaaacaaaaaaccctgattctcctgattctctctacaaaatgctaacatttaaatatgtcatttgtaaattgttaaccagaaggaacatgggaatgactgtaggttgagtttgaagtgtgaagtttgaaggcttagtttgcttgttttcaaagtgacagaagggagcaaaaggttatataaactccggtgggtacatacagttgctgtgggatattgacctgctgctaacttacctgccagggtttttccaggaacagtcagtgttagatcacgtttacttctgccacttgccaccagccacactgccttcaccgagtccaagaccctatcaccactggttggggctacttgtagctgtacacctgatctcgaagaaatataacttccctgtttaaagcccttcctagtgcccttaaaataagacccaaagacttcccaaatgtgccagggcccggcattatttacgtaacccccggctgctgtttgcttggcttgctaaacttttctacaaagtttctggccttacttctgttccttcaccaccccaagcacacgccctcctgcctgggaccctcttcacctttgtcctgctgtgccagctccttcttatcgcctaggtgtcagctcaatcatcacctcctttgcaaatcttccttgacccctagacctccctttcacaaagtaccttgagtttacactttgatgagtgtcttatgtctactgtaatactatgtcccaatgaagatgtactggcaatcataataggtagtattgggttaaaagcattagtttgctgtaggtacgttaggagtactccccatgtgattgatcagtgaatttaaaaatggctaaagtgggtaaccttaaatgatggtgcaaatataccttaaacattttatattttcattgaaaacacaagtgtacttgacacctcttgatgtagagcagaggctttttttcttcgaatatggggtcaccagtagaaggtctctggtgcatttcctgcataaactatgctctagtgcaacatctacaataattactttccttatttttgaagtggaccatatctcgacatttattaatcaatctgcatgtgtaaaacctttagatttttatgaattcctcctcaagctttatagtcaactatatgagtggattgccctctgtggatctgatagcaattttttaaatgattcacgtttcaacttgttaaaaacatttaatttagttaaaaaccaaacaaaaaagagctttgtttcttttcacattcatttctcagtttagatcatctttaattaaatataaatgtaagaaagttggaaaatgcaaagaaacgactcgttgtaagcacataactcacgtggggggaacagacatgggtgggcacactagcaaacacctgccagctgcatgtggacccaggtgggcaccggactgttttaaacacaggagagggcccattgtctaactggtgagttggttgagtggaagctggttgagaacttttactgcaaaccatttacagtagaccacaattttatagtcctgtttggcactttttcatatcactgggagcctgaagaaatagaagtgggttggatctctttcagcctcggaaaagcctgccattcccccatctaaaaaccctttccccattctcttactctgtctcatcatgtatgtaacatgtatccatgtatcatcattaagtgatctcattttatattgtttacttgaatatttcctgtaacccccctgtctgattccactagaatgtgagctctatgatggccaagcctctggctgcactgtgccccgtgtgtccccagcatcctggtggggctcaatacacagagagctcataagtagcatttgaatacatgaatcaaagtatggaatggcccagtttactgcagcctttttgcaggtgcaaaagatgatcttttagaaagcagaaacagggggtctggtgcatgagatctttttctcaatgtgactgtgctgtgcagaccttcacgtggtgtcttgtgaaagactttgaccactgtgtggactttccttcagtgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctccgggttcaagcgattctcctacctcagcctcccaagtagctggaattacatgcatgtgccaccatgcctggctaattttacatttttagtagagacagggtttctccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaactaaaaaaaaaaaatacctactgaaaaaactgtcatcgtttcacatttctggctacgttagtgcaaaagggaataaataaaggtgagatttgtgtgacagtgtggatatggtactgtgtgacaactcagttctcccatcacttccacctgtttgaatcatcgggatcctttatttgtacaccatgttatcggtatttgcccttaagcaccaccaatgcaccacttttatattaagtctgcccgttttccttagtactccataaaatttaagtcacatattactctgcctcaccatgttacttcaataattctgaatcaaagtttaagtttgtgaataattttgcaaaaaaagagccaatcatgcttctcaacaacataaaaagagaagcgccgtcacttcaggtgaatattgttctccgtgaggccatgagcataaacaaaaactccagactaaaaccctgagacggtgccaggtcattcagcagtcagcggaatgatcagtataatttcaaacaaagttttaaagatcattattgaaatgatgtattttgagcttcctggatctgttcctttatgtctaccttagttcatttgggctgctgtgacaaaaatatcataaactggagagtttataaacaacagaaatttatttctcaccgttctaggggctgtgatgtccaagaccaaggcactagcagtgtctggtgaggccctgcttcctcatagatgacacattctggctttgtcctcacatggtgtcaggggctagctaattccctggggcttctttcataagtgcactaatctctgtcctgagggtagagccctcgtaacctgattgactcccaaaagccccacctcagtactatcacattgaggattaagtttcaatataacttttgaggagacacaaacattcagaccatagctttatctatcatgaatttgggggaattttcagtcactgttgcttcaaatgtttcttctgtttctttctcttttttttttttttttttgagacagagtcttgctctgttgcccaggctggagtgcagtggcacgatctcagctcactgcaagctcctcctcccaggttcatgccattctcctgcctcagtctcccgagtagctgggactacaggcgcctgccaccacgccccgctaattttttgtatttttagtagagacagggtttcaccgtgttagccaggatggtctcgatctcctgaccttgcgatctgcccgcctcggcctcccaaattgctggcattataggcgtaagccaccatgcctggctttctctttttcttctctttctggtatttccaaaaagtctccatgttccaccttttgtaattgtctcacagttcttgactcttgttctgttttttctttttcattcttttctctcattgtgtgtcagcttttgaagtatctattgacatctctttgagctcactgattctttcattggccatatccattcttttgatgaacccatcaaaggcattcttcatttctgttatggtgttttttatttctagtatttcatctttatttcttcttagtgtttttatctctttgcttacattacccatctgttcttgcatgttatgccatttttacattagagcccctagcatgttaatcttagttattttaaattcctggttggatacttccgatatttctttcatatctgagtctggttctgatgcttgctctgtctcttcaaactgtggggtttcttgtcttttagtatgctttgtaattttttgtttgaggctgtatatgatgtactgggtgaaacgaactgagttaaataaggctttagtatgagattttgtgtttctctggctaggagttaggctttgtttactctttgctatatagtcatggatgtcagaggctaaaatttcctctagtgtccttgtgttgtctcccctgtcttctctggggagctccctagaggcttctttgtaaagtagctctgagtcttgcagtgtctatccctaatcatgggaaaacatcaaacaaacccatacagcgggacatctgacaaagtaccaagtgtcaaggatcatggattgaatcctgaaacagaggaaggacactgaaggaaagactgggaaaacctgactgaggtctggagtttagttagtgatactataccaagacgaatttcttagttttgataatttgttaacagttatgttaacattgggggtagctatgcaaggggtgtgagaatgctgttatatctttaaccttggcccatggttaaggtgtttccagtgtaaggtcactgttattccttgtagttaacatatatttggcaccacaggattcattctggaattctccttggcttatttataactttttttctagtagtgagaaacctggctttcatgcagagtttacaaacgccaatttaaacttttgttttgtcatacgcaatgattttattacctgtctttatttcagagcttatgaatttttaattattctaagggctaacatagaacttttccatgttttctactcttcaagagtaggtaagactttagtttgtaatacattacaaaaggaatcctgtggttctctaagagctaatttgtcttggcaaaaggccttagcaagctgtgagtggtggctcatgcctgtaatcccagcactttgatctgagacggctggatcacctgaggccagaagtttgagaccagttttgccaacatggcgaaaccccatctctgctaaaaatacaaaaaattagccaggcataatgccatgcacctgtagtcccagctacttgggaggctgaggcaggagaatcgcttgaacctcggaagtggaggttgcagtgagccgagattgtgccactgcactccagcctgggaaacagcgagactgtctcaaaacaaacaaaaaaaccaaaaaacaaaaaaattagacgggcgtggtggcatgcacctacagtcccagctactcaggaggctgaggcaggagaatcgcttgaacccaggagttggaggttgcactgagcagagatcatgccgctgcactctagcctgggtgacacagtgagtatccatctcaaaacaacaacaacaacaacaacaacaaaaacaaattaaaaaacccaacaacaacaaaaccagcaaacaaaaaaactaaacaggctttagggaaagagcaatctaattatctgattatatgattggcactaagatgggaatgactctggcctgatttcttcagtttacattttaaaataggagcttagttagcccccaaataatatgtaattgatgtattagcgttggggagtgaatatttttcaaagcagaagatatttctcaattcttgcttacttttagaggttgaagttcaaggaagccccttccttggcactgtatcccagggaggtatttggagttaatttcagggcttagcagtgactctttagaaaagcagtatacgattgaaatgtaatgtgttacaaatgagatcactacaagtaatttaaaaatgtgctagtagtgtttttttttctgagacggagtctcgctctgaagcccaggctggagtgcagtggcacgatctcagctcactgcaagctccgcctcccgggttcgcgccattctcctgcctcagcctccctagtagctgggactacaggcgcctgccaacacgtctggctaattttttgtatttttagtagagacggggtttcaccgtgttagccaggatggtctcggtctcctgacctcgtgatcctcccacctcagcctcccaaagtgctgggattacaggagtgagccaccacacccagcctctagtagtacttttatcaaaagtaaatagaaacatgaaattaattttcacaatacattttatttaaactaatatgttcacaatgttaaaatttcaacatgtaatcactataaaaactactagtgagatatttcacattacttttttcatgtaagcctttgaaatctggtgtgtattttatatttactgtacatcctgatttggaataaccacatttcaatctttcaatagccacatgtggctagtggctactgtgttagagcagttctagaacaaaggagtccctttaaaactattttgaagtcatcgtctataaggcaatatgaaagctgatctgaatgatttctccttttccaggaaaggaaacaaaaatgaaatcatgttagggctgcatattttatggatcccaggagaaatacacagtctgaaagaatgatctcagtcagaaactcagaatgaatcatatgaattaaacattggacaatgtccaatgctcagcatgtgtttttggtttatactaagagcatattatgccaccaaatacagatatttactattatacttcgtgtaggaggtatattgagacattgttctagactaccacagttccatattttgtgaaaagttatattgcactttttttttttttgagagtgtgcccaggctggagtgcaatggcatgatctcagctcactccagcctccacccccccaggttcaagggattctcctgcctcagcctccctagtagctgggattacaggtgggcaccaccacatctggctaattgttgtatttttagtagagatggggtttcgtcatgttggccaggctggtctcgaactcctgatctcaggtgatgcacctgcctcagcctcccaaagtgttaggattacaggcgtgatccaccatgcccagccttatatttcactctttgggaattgcatcttactgtaatcttaaactacactaaaataaataatgtaaaccttttgtcaaattgctcagagtaggtttctactttggttataaggaataaaattcatgcttttgtgtacacactagacatctaaagcaaccaaccatagttaacaagcagtgctcttaccaaaaggtaactctttctagaatctggcacaccatttaatatcagtatgagcatatggtgggtttaataattgttttccatgtttataagttttctttagttttataagcagttaaaatgaatccctttcactgaaatacaatctgtggtgggacttctagcttttctcgatcttacgctgctagatttatgtcactgccatagctatgcaatgggtgatatttacactatgctcaaacaaagcaaccagaaaaacacatcattgaataatacagatattctgaagtcaagcaagccaactttcattaacagatcaatttccttagaaaagttgatgaaactaaagactgaagttcaaagaaaaagccctctcaagggggtatgaatttctggtaacttatggggtaagaaaaagagcaagaaacttgaaagtagggaagagaaaaaagaaaaggagcaagagggaatagccagctctcaaaagagtctccaataggaaagcaaaatctgtatctagccagtaccaacatgtgaagaaagagtgagcatagcaaaattgagaaaggttgcttgaaaaccaaacaaaaaaccaaatacctgtaatcctagcactttgggagggtgaggtgggtggattgcctgcactcaggagttcaagaccagctgggcaacatggtgaaaccttgtctctactaaaatccaaaaaaaaaaaaaaaaattagccaggcatgggctgggctgggctgttttccaggctggtctcaaattcctgggcttaagtgatcctcccacttcagcctcacagtgttgggattacagtcacgagccactgtacccaaccatatgtcattctttagacacactgcttactaaatttctctttttaaaggatatactgaatttccggttgagccaacttaacagctaattttctattttagctttaaaacattgataagcaacatgaagcaatctagaacttaacctttaagtggctttattaaagcaatccagctatgaaaattatgcagaaatgattatctacaatcttaccagcacataagaaattcttcctctattctgaaataccatcttctcacaatatactttgatgttatgaatcaatgtctgttcttgaacattatttattgtctttctctattaaacaattccaaaataaaatttccagcacaactaaatattgttgatgataagaggatttttaaaaaagttcttttaaaacagaagcttatatacaacttagaatctaaaaccaatagatttatggtaaaccttaaaactgaaccaaaacaaacaaaaaccaaagttttaatcatttaaaaatcatgtttattgaggtacaacttatagtaaaacctgcccttttcagcgtatagcactgagtcttgacaaatgcacagttatgtaccaccaccgaccaaggcctggcacatttttacctcctcaaagttctccctggctgcttctcccactccttggcaaccactaacctgttttctgtccttatagtactgcttttttcagtgtcatataagtagaatcacactgtacatagtattttgagtctgacctctgtcaactggcataatgcatttgagaattatccatgttgctgtactggcagtgcattcttttttattgctgagcagtattcaattgcatggctgtaccagtttgtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattacccttccagacacctttctgtgttttcatacgtatatatgtatgacggtttgaccttaggcagagtagcattttcaaaattttacatggggaaactttctagatttaaagccattttatttttctgttctgtctggttttatctacgtgttatttacaatctgctgtgtaacaaattactacaaacttagtaccttaacacatatttatttcacagtttctgtgggtcaggagatcagaaatggttctatttcaaggtctctcacagggctgcaatcaagatgttggcatggctggggtctcatctgaaggctggactggagaagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtatgctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctcagatctggcaggctattgtgaggcaatgtgtcattttaccttataacgcagagttgtaacatgctactctgagcagctcatgacatctgcttgaaatttaagttgggcccctagtatgtgtttattataaagattttgatgctgcttttcagagttgggtaacctactttacccccttagctaatgtttcccaaatacacccaaacccacagaaaggaaaactattcctcattaactcacagccaacatcataaacattttatatctagagctgatgatacagtcaggtatttaccaacactcatgtatatatgtagagtttcaagaaataattgcttatccttactagattcaacatattctaatgtttcacatattatttttatttcttaattttttttttaaagatggggttttactctgttgcccaggctgaaatgcagtggcatgaccaggatttcgaccagaagtttgactgcagcctcaaactccttataacaaagaatcctgctgccttagcctcccgagtagctaggactatgggcacatgccaccagatctggtatattttaaaatttttgtagacatagggtctcgccatgttgcccacgctgattctgaactcctgttctcaagcaatcctcctgcctggtcttcccaaacttttgggcttacagctgtgagtcactgaccccagcttgtattcttttgattttaaaaaaatattctgaatgtgatccaccaaattaatttcaccatccactaataggtagcaacctgaatgaaaaatactgttataaactttacacaaaaccagagattataaacatttgcttccaaggagagaggtaaaaggtacttgtttgctctgatgggccctgtttccttcagtgccaggaagagtggctctcagacctttcttctggcatccctcatgtatgcagtgttggttattattttcaaggccttggtaaccaaatgcccctagtgtgaccagtcagactgacagtccatatctgtaatatggtggtaagtttcctttgcatgtctttctttctggcatcttagaacttttacctaggaaattttctttttgcttgaagtacatcattaagaattttcagtgaaggcagattcttaaagtttttgttttccagaagagatcttggaaaatataaaaggttggcagttatttcttttagtacatgagatagtattacaccaatgctgttgagaagtctattgtgaggcaatgtgtcttctttctctggctgcttttgagatttctctctgtcttttttaggggcagttttactcttatgtgactagaagtagatttcttcttttttttttaatattgcttgagattttattgggtttttgaatctgtggatagatatccttcaacagttctgaaagatttccagccattctcttcatatattatctgtgctgtattcttgtctctccttttagaacttcgattagtaaaaacatgtttgatgtcttttcccactcttgttttttgtttctcccatgctgaattctgtgtaatttcttttgaactatcttgtagtttacatttttttttttttttttttttttttgagataagagttttgctcttgttgctcgggctggagtgcaatggcaccatcttggctcactgcaacctctgcctcctgggttcaagcagttctcctacctcagcctcccaagtagctgggattacaggcatgcaccaccacgcccagctaatttttgtattctgagtagagacggggtttcaccatgttggccaggctggtctcgaactcctgacctcaggtgatctaccctcctcagcctcccaaagtgctggattacaggtgtgagccaccgtgccaggccttacattctctctcttaaagagaaaatgtaaggtatctaaatctgctgctaaaccatcattgtttttaattgtaataaggtctcttttatgtactcacattgataagagacaagtaggaaataatctttaaagggcaaactaatttaaatgtgttttcctgtctgtttacaggacttaccaaatgcacatcttagagttctgggtttctaatgtgtatctcctctatgaaattctttaaaaatatctgttcttggtatcccttaggttagtctcttttagaacttctaaatcaatggacccttaacttataggagccacctggacgttagcaacgtctacattaaacatgctgagcttttaaaagagacctgttagacatgctgagtattttgagataatatcattgttgtattgaaaactattgaaaactttaattttaaaatgcaaacattcttaaagtcctggttaattttataactataaaattagttataattttgagatttctgtcttgttttttataggggcagttttactcttaggtgactagaagtagatttcttcttttttataactataaaattaggtttacttttgttagaataaattaaagacagtgaacttgtaatttgaataactactaaaaatatacatgatgtattcttatttgggcccttgtgacaaaaatactattgtggctatagaaacctatcctatagtttgaagaactgagattactgtcagtattgagaacattcctccttcatcattagaaagattattaaaaaccagattcaaagaaactatcaatactacttatgaagtatgtctgtaaaaaaaattaagcctgaatcttatcaggcctctagaccagggattctcaaggtatgggccccagaccagaagtatcagcaacgaattgctaaaaatgcagaatcttgggtcagaaattggggaccagcaattggaattttagtaagtataccagatgattcagatgcctgctcaattttgaggatgactcttatcagtttagttattaggatttacaggggatggggaacatgttaaagagcaccaactagataaggtcaatcagtcaaaagtaagatgtctggacattctgggcctcctgatgtcttagaaagcacacaataccatctatggtgtatttttgtccaccatcccacccaattgcacctggatcttcctatttataggcaattagaacaagctcagtgttaccctgtaatgattaaaaaccaaatataggactgctatagcataaatgaccactttcttcaattaataagtggcacattaaaaatatatttatatatgtaattgttatagataaaaaaaacaaaatggccgggcgtggtggctcacacctgtaatcccagcactttgggaggccaaggcgggcagatgacaaggtcaggagattgagaccatcctggccaacatggtgaaacctcgtctctactaaaaatagaaaaattagctggcgtgcatctgtagtcccagctacttgggaggctgacgcaggagaatcgcttgaatccgggaggcggaggttgcagtgagccatgatcggaccactgcactccagccagggtgacagagcaacactacgtctcaaacaaacaaaaacacaacaacaaaataaagcttaaggaacatcaaccaaatgcaatatatgagccctatttaggatactataaaaagacattcacaataacacaggcaaaatgaacataaactaggtataggtgacagagaaatccaataaacattgaattattcactggggaaagaaatgatgtgtgggatttaagtctctaactctcccctatttacgccaaaagattgtccatgagttgaaaaccgttagagatgggtgacaactcaagagagattatagcgtcttccttgtgcttgtaaatgtcaaaaataaaagtaatttaaaactaaaacaaaaatgaaaccataattcttaagatgcagcttgaattcagttaactatagcagttgtatatgaagcatttcaaagaagttaatgacatcacagtattaaatccatctgacatggaaaccaactctaactacatcatagttttttttttttttttttttttttttttttttgagatgggagtctcgctctgccgtcaggctggagtacagtggcgtgacagatcactgcaacctccacctcgtgagttcaagcgactctcctgcctcagcctcctgagtagctgggactacaggcacatgccaccacgtccagctaatttttgtatttttagtagagacgagatttcaccatgttggccaggatagtctcagtatcttgatcttgtgatccgcctgcctcggcctcccaaagtggtgggattataggcatgaaccaccagtgcctggcctatggcacagttttaaaactgcatttgcctagaaagtggactgctgtatatagaccaagtgttgggctatatgactccattgtcttaggctatttggggttggaggaaggaagaggggtgaagtagaaaaggaacaagctaataaatgttttttaaaaagtagaatttaaaacaaaaccacgttcagctgaacaccagaactcaacaccaggataaaaatccaattttcaaagagctagaagatcaagctaagcacttattgtattttgctgaacgttaaaattatataaatgtactacagttgcctcaagatgttaaaaagtcagcttttcaaatctagtcacggcctactcatatgacagacccaatacaaatgagcaaaattgaaaagttacacatacagacaacttctcaaccaccaggctgtttagtttaagttagaagtcagaagttctgagactctccttttacccaccttgagcaaccgcagcaagttttcccttttcttcagggctgagctgcaacatcgtatttataacaggaagaaggctctctctctcactacctggcttcaagaaaatgaactgcagcaagacgttcttcaagtgttccacgttagctgcagactcctcttgattcctttccaatcttcttatttcacttttgagaagctggtgttagagaaatgagttaaaaatgggctttaggagcttctgattaaatatggcagactgaactcatgtatttttcttctcttccccccaaatttcccccttccctccatatggcaataaaggaaggaattcagttaactacagcagctgcatgtgaagcatttcaaaggagtttatgacatcaccgtataaaatccatttgacatgaaaaccggaactccaactatgagatagtttcaaagctgcatttgcctagaaagtggattgctgcatatgaaccaagtgttgggctatatgactccattgtcctaagctatttggggttggaaggaagaggggtgaagtagaaaagcaacaagctaatacaagaggagaaaaagtagatgagataacgtcaagacattctcacgagaaacagatgaagaggtggaaatgagtcagtccagcagcttaccaagtatcactgacaggagaggatgcatcctgtgtaaatactggagttcttgtctcagaagcacagggtatcatggaaatggagttgaaagctggggaactgatggaacgtctccatgaggagcaactaactggagccatgggttggtaccaagatgttccctctgccttctacttttgatagaaactaagccagtatggcatggggctctgaaaatgggctgaggggaacatcggtagcctccactaaccccctgcccctacgctgttcctgaagtcccaggcagttaagacgtccacagtgaacggcacttaaaaagttcagacacagtgaaaattcaggaatataagacaatgtaaaacactatcagagaaatgaggcaaagaacgatataaaaaaggtagtatcatgttcaagtctttgaggaagatttccaggttgaaaccaagccatagcttttagtatattttcattttaggttaggcaagaaagttagcgaactttgtcctcaaacctaggaccatttaaaaaagtgacaataaagaagacgaagaaatcatgaagagagtataaatttatgaaaatataacatttggccaggcgtggtggctcatgcctgtaatcccaacactttgggaggctgaggcaggcagatcatgaggtcaggagattcagaccgtcctggccaacatggtgaaaccgtgtctctagtaaaataaaaaaaattagccgggcatggtggtgcgtgcctgcagtcccagctactcgggaggctgaggcaggggaatcgcttgaacctgggaggcggagattgcagtgagctgagattgcaccactgcactccaaacctggtgacagagcaagactatctcaaaaaaaaaaaaaaaagaaaatataacatttaaataagtcatttaggtttactgggctagttagtgatttgttagctatgataatgtttttattagtgggaaaatgctattttatagagatgcatactgaagtatttaatggtggaatgtcatgatatatacaatttactgaaaataactgaattcggctttaaaataatctgacaaggatagctagtggccttgcacagtggcaggacagatctactaggaacagcaaagtacaggggaaaagcatgtacttttcagacagctatgagtttgaattttgttccaccatttaccagcttcaatttttctctcaaccagtgatgagattaaataatgtatgtagagcccagggcctgggtcataagaactcctcaataagcagtatgactatattctgaggggtgatttatcagtgagccagggtggaaatacctcatttgagtaatcctcaactgttctgcaacattcctagatgtttctggtgtctactttaaacaggaaaaacttcccatgccactttgccatctccacctgaaaactgtttagtagttcagtactataaatatcagttgaataatttaaattcactggttatctttagaattcaaagactcacacccattttttatttaagcatatgtgaacaatgatttgtgaacatctctctagtttctaaatctattacggtttcttaggaaaagtaggaattaagaaataatctttatgtaataggtgtaaaagaagtattttggctggatgcggtggctcttgcctgtaatacccacactttgggaggccaaggcaggtggatcacgaggtcaggagatcgagaccatcctggctaacatggtaaaccctgtctctactaaaaatacaaagaaattagccaggcatgttggcgggcacctgtagtcccagctactcgggaggctgaggcaggagaatggcgtgaacctgggaggtggagcttgcagtgagccgagatcgtgccactgcactccagcctgggtgacagagcaagactgtctcaaaaaaaaaaaaaaaaaaaaaaaaaaaaggcaatatttatttctcaccatcaggaatctaataatctaatataaagatcaagacgttatagatgcatctgcaatgtgaatttttaaacttgggtgcatgtgtatggagggtccagaaaaccaaactggcggttttcacagtggccaggtttctgatctcaccttaatttgctccataaggactgcactggttgcctctgtttcccgaagcaggccgtttaactgatctgcactttttgtggtggaactgagcttctgaaccaattcttctttggtaaattcagcatgccataatggaggctctgcaacatgttgttccaagaattaattttcaaaatcatacattacagatgaagattctaaataagaaaaatctaaatataaatatcttactatgtgatattttataggtctgctttctttgccattcatctattcaacatacctcaatcaacagattatatgttgtaggtgacacaaataaaacagtatctctgttgtaaagcatgtaatctaactgaatacaagccctatgagtcccagttctgaaatttgtcagaattgtgtttatagacagttttattacacatcttcttcccatctattaatattccaagattttatgtcatttcacgtataaggaaagcattaacatttactggtcacgtatcatgttccctcataagaatcttctatcaggcggggtaggtatcattattcaaactttacagacgatgaaacaggctcacagttgacaggtaattttttcagaaatcacaaagtcaaattggcttctggagtctgctgctctatcatgatgcctccgtgtcaccactattaactttgcctgaaggaaccatgacttgcagtttctaccccatgtggtcagtgaccatgaatacaaatgacccttactccaggtgattctgaagtttcaggaagatgacagattccccctaaattttgaacagtaatattaattacaggtaataaaatataccaaaacatcactacaaaaatttagcattacttcatcaagaggaataaactgaaactgtcagtttcttggaagggtgagaggatagtttatcctgctttctaatacccaccacctatttgtgactataaacttcccaccacttatttatggttcaagcctagggcaagagctagcattttattttaaaaaagatttgtttaataatttttccatttggacagtgtgatggttaatactgggtgtcaacttgattggattaaaggatgcaaagtattaatcctgagtgttgtctgtgagggtgttgccaaaggagattaacatttgagtcagtgggctggggaaggcagacccacccttaacctggtaggtgccatctaatcagctgccagcgaatataaagcaggcagaaaaacctgaaaaggcgagactggcctagcctcccaacctacatctttctcctgtgctggatgcttcctgcccttgaacatcagactcctagttcttcagttttggaacttggactggctctcgttgctcctcagtctgcagatggcctagtgatcgtgtaaggtaatacttaataagcatccatccatccatctcatccatccatccaaccatccaattagctctgtccctctagagaaccctaatacaaacaggtagtggaatattgaaagaaattttattggagcagcccaaaaaagcatatgtaccttagagtaatagtaattaaataagacagtgaaattaaagaagaagaacatatttagacagagtaacagaccaagtttagtttcgggagaattaagcagctgctctaaagactgtgtgtatgtgctggcggaagacacagactccgtaatcagttgtctccatgccttctccctcttcccgggttacagtgtgcatgtctagaagcgggaggtctgtgtttctcctttctcgaaggttcttcaaagactgctgagaggaaactgggcctattagattttttttaaaggttaagtgtgagattgttcaaaatctattgattcggccttacagagatacacaataaaatgaaaatatcaaatgataagagtagaggaattaagtaactataagtgaaaggtgtatgaagaattgctaaaacatttcctaaaatttagtcatcaaggccaggcgtggtggctcaaatctgtaatcctagcagtttgggaggctaaggtgggtggatcacgaggtcagcaagttcaagaccagcctggccaagatggtgaaaccctatctctactaaaaatacaaaaattagccaggcacggtggcaggtgcctgtaatcccagctgctggggaggctgaggcagagaattgctggaagccaggaggcggaggttgcagtgagccaagatcatgccactgcactccagcctggcgacagagcgagactccagctcaaaaaaacaaacaaacaaacaaaaaaaaacttagtcatcaaacttttaactacgttagtcattttaatagcagctataaattaattgctactagctaagataaactgttagataacacagctcataatatagtactacttattttttattaatttagagtagagggccaaactactgctaaatactggccaaaattaaaagactagattctagcaatttttcaggattaggtatttcagattgcggcatacttcttgaaacacacttgccgaaatctgcttggtagacatcctcaatcactgcccttatacctttacctctgcagcttcttaattgttgctgctcacacctacagtgctcatacagttaagagcccagaatccagggcacagaactaatcaattacgttgcctagcaagactttcctgtttgctgataaactatattttttctgagacagggtctcactctgtcacacaggttggagtgcagtggcacgatcttggctcacagcaacctctgcctcccaggctcaagccatcctcccacctcagccccacaagtagctgggacttccaggtgcatgccatcccgcccagataatttttgtacttttaatagagatgggatttcaccatgttgttcagactggtctcaaactcctggcctcatgtgatccacccgccttggcctcccaaagtgctgagattgcaggggtgagacaccacgcctggtctaaactgtaaagtttatcgggccctttgacatgtattggtttattgactcccaaaaatctgaagttcagagaaatttaatgactttgcccaaggtctcataactgagttagaaaccagaattgtaatctagatttttaaacttcagatttcatttattttgcatttcattaaattgccttagtcctgactgccctttctaaagcattttcctgggtttctggtaagctgactgcttattccactgctgattgctagattacaatctcttgtgcgacctttgccctggctgattacttcctttgttgattctttggcatatgttaaattcttctgaagttgcttttttaccctaataagtgaccgatagctgctaatgctccagtgacaatatttcccatgggaaaccaaaacaccatcaacttgctactaaaatactgcatcatcatggctgacatttttccatttcttcctggaagcagaatggaagatactgggtacggctgaactaaaactccaactaattgtaaatatgaaagcaaagaagctatattggttatgcaattctacacattcagtgctgcttgagtgtttctaagttccttgctctagctaatgtttctatttaaaaagtagacaaatttgatgactaacaacggagaacacgaaacaaatctggtgaataccagaattaagacatgtgtcagccaggcgcagtggctcatgcctgtaatcccagcactttgggaggccgaggcgggtggatcacgaggtcaggagaccgagactatctgagggagaatcttcaggttttttcttctcttttgctgtaacaccagtcaaaaaaattgacaaagataaggtattaagtattgacgttaatactctacctgaaaataaaaaccatggaacctatctataggttaaaacagcatactgataaaaaacacatatactttgatgcagagatgtacgataatcatgaattagaattagcatcctgatttagttttctaccaaaaaccctaagtgaacacagaatctatttaaaacgaaagaaaacaaaaaaatcttgtgtttacttaatagtcattgaaaagaattactacaaatttctagaatttaaaaaggttaaaaattttaaagtgttgcctaactatacttagcatacaatagtttaccaaaatatccatgcatttgcagcaattgaaaaaaatcttaaaacataagcaagtattagtatacatatgaaactaatccaaagccaactgtgattagttcctgtaaggaaagttaacaattgccaagaatggaaggtgactagagttgcatctagtttgcctgtgttcaagcatgatactagataaaattaaataaaaactgttactctatgggtagctaacactataaaatctaagaccattcatatggctgaaaacaacccatccccagccaccatcaatgcaaagggcaaaaaattagaaacagaaaaaacttctatatgcaacctgttctgatctattaatgtaaagaacaacttctggctaaaggagtttaataaagtaagccagttatgaagcatgccatgtataccaactggtgacagggaaacattctgagagctatggtgtccaatatggtagcctagccacattctattaaaacctcacaaggtggctagtccaaatcaagacatgctaacagtaagtgtaaacacacacactggattttgaagacttggtgaaaaacaataatgtaaaatatcattaatttttatattaattagaagttaaaatgatattttggacataatgagttaaatcaaatctatcgataaagttactttcatctgtttccctttttaactgtttctttttattctttttaatatggctactagaaaatttatttatttatgtatttatttgagatgcggtcttgctttgtcacccagagctggagtgcagtgatgtgatcatagttcactgaagcctggaacttgtgggctcaagtgatccctctgcctcagcctcccaagtaactgggattataggcacaagccattgcaccaaatgacaattttaaattacatacacaggttatattttatttctattggatgacactgctctgcagaaccagtgcccttccttttacaatgttaaatttgtccctctccttcattataaacgaaaacctagtatcatttcctagctaggagaaataacagtacaccgtaagatacagattcttgttccacttctgctattactcagtaaagacctcttgggtaaatcagatagcctctcttggcctcagtttactcatgtctaaagtcttcatttctaaggtcccttgggacaatgacattatcagattcaaaacagaataaggctctatgttctacagtagtgtataggcacattcgttcttaggtcagggattcctaacctagagctcacagaaactgtacgcaagtatacatccacttttaagttaacacttttcacatttctcaaagaccgtatctttaaaataaaagattaagagctaccttagctggtaataaaactggtatacttaaaaaaaaatcagagattgttattttatcattgtacttgtttggcatggctaagatgtgttactggtcactaagggtgaggtttcacttccctaacctgttcttgaaggccttcaacagatcccacttcttgttccactctagtagccacacttctaaaaatgatctgtgcaacatatataatatgcaagctgtagaatgctggctgttaaaaatggggtccattttcaaatacaacatttttctaaaccatgcacaaaagaacagccctacagggacactcttccatactgtatacatgccgttgccactacatgtgaatactggcagacgttagtggctaaagataaacattagataaaacataggtcttcactgagcagacctgaaatagcagagcaatgaagtacattacaaatcagcatcccagtacattttaaaaaacaaaccaacaagggtgtcatgccaccagtcaaaaggtactttgcttaaactggcattctttaacattcatgttgtagtggtaagtacttcatttcatacagccacagttattaatactttcctaagggctaccagctgctaaaaactgctgttatctcatactgagaatgctagttctatacctttgctctcaggctgtgaggaaggggtgctagtccaaaaggccatgggattagatttaaaaaggctaaaattaaatcctagaaaataaagaatatttcattttttaacattttaggaaacaaaatgaatatgcttttaaaacataaaaagccagaatccctcaatttataccaccaatctgactgtcttacatattcatttatccctgtagtttcattctttgctcatttaatacatgagcaagactgacatacaacacataaaatgagaacatctcaatatcatggttttttttgtttttttgtttttttttttttttttggagacaaagtctcactcagtcaggctggagtgcagtggcatgatttcagctcactgctacctccatctcctgtgctcaagcgatccacctgcctcaacctcctgagtagctgctaattataggcacgcaccaccacgcccggctcatttttgtattttcagtagaaacagggtttcaccacattggccaggctggtctcgaactcctgagctcaagtgatctgcccacctcaacctcccaaagtgctggcattctaggagtgagccaccgtgcccagcctcaatatcatgttttctgagtgacaaaagaaacagaacaaatgaaaatgaacactttaaaaaaagactcacgttaatgcgcatgattcaagcatgagtccgtacactgtaccaagttcttttgctctgccctagcatgatagaagtatcttccagttactgaaatgtctttaactaagttctcttgctctttgaaacctcaccgtgaacttattaagggagaaaaaaaattgctcaaatattttgggggtgttcacaaagcatcgtttatatcccaacattagtatcccacaaagagtctgcatcaagctaaacattaaaagaaagaaaaattgtgcttaactttaacaacaaagtacctacccttttctggtgttttaaatgtgtagttgattgaagattcttccattggaaaggaagcagagagatttttgactttgctatctgaagactgttcgatatcagagttctttgacagttcacattttttaggttccactttgctttcagatccactctgggctactgaactagtttcactatcgttacttttcaaaggtgcattaaaactaaatccaaacaaagacccagtggcagaactgttgccaaatgcaaatgggtttgatttttcactactaaaaattcttttaacagactctgaaccaaatacaaactttggaggagaaaccactgcttttgttgttgtttcagatgtgctagacacttcaacttctgaagctgcatctgctacatcatcaccctgaataacatctgtcctctctcttgtggtttcttctaatacagctacagcaattttgccacatggtgactctctgggagtgcttgaccgagaaacatgaggtgttatcaaagaatctttttcctgggctgtttttgcttcatcaaaaattttcttaaatgagtctgcaacatcctgtagtttaaaacgaacagctaaatgctctacttttctttctccatctgcaaaatcacatgcagtccacacccatactctttctgtccctttcatattttgcaaactcatgtctggagttattctgtgattggcacaaagttttaatacttggtcccttctcatcactatacgaacttgcttattatcataattctgtaaaatctttatatcaccaatgcccctttctttccattgaccaacatctttatcatatctgtagagttctgccatgtgactaaaaacaacttgttcattttcctcaccactggatacttcaactagatcaggtaaaggaacaacaggttcaaagtactgtccatctctctcttcttcttgagtaacatcagattcttcatcagtgccaactgaagtcccactctgattcaacttggcaggagacttagatagactcaaagcagatttaaaactgaagttaaatcctgttgttgactcatcaaagcggaaaatattttttctcacagggctacttgccaacggagaatcatgtactgagctactactaacattatcatccaaagcatcttcccttaaatcatagttatcccattctaatgtgggcccagtgttttcaggattgggttttattgttgtgtctgaggcaccggctgcacctgtacctgaacccttattttcttcctcagtgacttttgtttgatcatttgtcaaaaacgttttgaaatctttcagtccactcttcatttcttcagctctctgtattagcttggcagctctgccagtatctacaagtttatggggagtttgaagtggtatgtctaacagaagccgctggcattcctcaaatttctgcttgaattcttcagccagctctggtgttttaaattgtgctgccaaccgctctagtttggcatcaccatcagagaaatcactggctaaccacatccatgctctatctgatccagagaggggcttcaggttcattgtagttgttatccaatgattagcacacacttttagtacttggtctcttcgcatcagcattcttggtttgccattgacctcatttttgagaatttttaagttccccaagcccctttctttccactgacttatctcagcatcaaatctaaatagttttaccccctgtgaatacagaactttttcaccttcttctcctgttacaagttctactttttcaggcatttgaactactggttcaaaatggatgtcatcgctgtcctcagtcttacaggcatcatcatctttctcaaagtcaccggaagtgtttgctttattggccattttaccgcattgtgatgagaataatttttctccagcacctgaaaatcccttgaaattggggtcttttttgccaaactgaaatccttctcctgaagttgattttgcaacatctgcaaatgtaaaagtgctacttgtttggccaaaaatcacaccacggccattcttctggccactaatatcctgagcctggaagccagtatcattttcaagaggcttttcacttttcttttcttgatttcctggttccgaaatgccaaatttaaatccatcagcagacacagcgatggaaaatccttctttggttgacttaaattctgtattagaagaaccctgaaacataaatgaaggtgaattttcttgatccacatgcccaaaatagtcatgaaataaataccttcttcattcctaaacaatttatcaaatgatgttaacaataatgatgatgatgatgatgataacatttattgagcatttattaatgtgccagctgggcactgttctaagcactttacattattatctcattttaatatcctcaaaaaccctatgaattaaggtattattattaccctcatttcacatatgaggcaactgatgcattgagaggttaagaaacttgcctgtggtcaaaataagcagaagaacaagggtctaaatgcaccccaacactctgtcctcaaagctgtcacattcaactaccactgtaatattgagtcttcaatcaattgttatatatatagctgtatcaggcctgaaagtacttaccacatagtgggtcagcaagggcattacagttctatttctgttaaaacagaacgatgaaggatccaccaccaccactcccatttttaaaatattctaaatattcacacttattaacacaaaaataaggtgactaagaaggataatttctgtatttggagataaatttaaaatatctacattttaagggacataaaagttttaatagtgaactgctctcttgaatttatttgaaggaaccctaaacaatttaaaaagaaaataattataaatgtataaattattcctttgttacctttgtgggagtaacattagctgctggtctgagaagatactgggaattatatgctggtgactgactataatatactgaagggccagtagttgcaactaaaaaaaaaaaaagaaaagaaagaaaacactgttaaagtctatactacagttaagactatctaggcaagagctataaatacaaaagcaatagaaattaaagaaagatttaactacataaattttaaatttctgtacatcaaaatataccaatcaagattatcaaatgacaaactagaaaaaaattgctaaatatgacatgaagaataagagaatagcatcgctgtgatcaacaagaactacctcacaagcattaaaaaaggaataaaggagaaagtaactgttgccttttctaagaaagatcagtatgatgtggaattatggacattcagtcacagaaaggacgtaaggaaccaagatgccatctgatggtcaatgcatttgaagtgggcctagaaaatctgcagaaagactaggttgtattttgtaaactaaagctattactgagaatgttcagctcaaaaatcacctgacaaattcatggaaaggatgtcataaataacataaaatgtgttccctggcttaaaataaaaagcacatcaacactcatacagatgtacaaactgtctgctccctctgtttggtctgttttaccaggaaacaaaacgactagaaggcacccatgttaatgacaaaactaccaatagtcatttgcttgaactgttttatgatagttttaccagaaaacaaccaaaagaccttttatgcctgtacatggaagaagaaacagaaactgtgccaagaggttccaaacaattgcctctggaaagcactgaaaaatcaagacctagaaaaggctagccagaagcccaagtttgattttggaaaccttacagaggtgaggataactattttgaaattactatggggaggaagcaggcacagaacacagaacaacctgacagaaatggcccaagaatcttaaagtcttgcaaaatgtctgtctgcatgaaagcaaaaagaaaaaataaaatattaaataaaaaaaaaatcttagtctgaagtttaagtagggactttaattgactactgactctaaactgtgaggctctaataaatatactaaaagtaatctaattttttaaagcaccatatgaatagacaatttaggaaagaaatgttaataggcctcaaggaacatgtttttgaagtgagccttgaaaatctgcaaaatgacaaggttgcattgtgcaaattgaagctattatgagaatgttcaagtcaaaaaaattacctgacaaattcatgcacaggatctcacaaggaacacaaatgtgttcgttggctttaaaaaaatcacattaacattcatgttgatatacaaaaactcttctccatctgttttgtgtgagttttaccaagaaaccaaacaactggaaggtacccacgttgaagatggcaaaactaccaactgccatttgcatgaattgttgagcatgactagtattaaaaaaacttaaaaattgatataacttttgttcctacaaattggcaaaggattttataaactagtaagtcagcattagcaaaagtgcgaaaatggcactatcagatactagtggtaagagcataaactgaatattttgaataccctacaaaactaggacagtgtcctagaatttgtaatggcataaaccagaaacaacataaataaaggaacagaatttacagtacttccatgtgatgggacaccatgaactcattaatattcaaaaaacatttaagtttaaaaatgctcagaactaaagtaacatttaaaaaacaggctagctcatctacacacaacatagtaacatggtaacaatctcataaaaaatactatatgtatagagaaagaaccagaaggaaatgctctcaaatataagaaatgttaataaggtggttagtttttagttttcttcaccctgttcagtacttctgagtatctcctatgagctcattaatctttaattttaatcatcttattttaaaaaaacaaggaccatcttgatatatgtttacttttattaaggaaaaagaatctatgaacacaggaacagaaatcaggagatcttggctctcgccctttcagtgccacaaagctgttttgtgaacctgtaaataatccatttggagtctccatgtttctcaattgtaaaatgaggatatgctgcttctacacatttcacagggtcattgcaagaataaaatgagacaatgagaatgttggatttacatgcttgtataagaacagaagaccttttatgcctgtacacagaagaaatggaaatcatgacccacaaggcaccaaataactgactgcacacgtcactaaaaaagccccaggaaaggctagccggtttgtttatcctcttacaaggacctatatgatgtgtaaggttttaagaaaacaaggtttgaacgttagacatttcatatacttatctatgacttacgacatttaataagcttgacttcacaaagattttctgttattttgcttgtgttgagaagatactatcacaaaaggctagtggggttgccttaactataggaaccatcacacaaatgtgctcatctaaactagattttattctaaatctttcctgggctaaaaagagaaaaaaaaaagggcactactactaccatttcagaagtctgtcgtacgtaaaaggaacaatttttttatttctggctgcctgggagcaatgtattatactggcaagtgctttggagttacaccactggagtgtgaatctcggctctatcaataactagctgtataataatgagtaagttacctaacctttctttatccatttccttatttataaaaaagggattaataatggtaccggccattctaagttactgtaattaaatcaaattacattcacaaagcacttttgcacatagccaacccacagtaaacactattagtaaccttagttcattaactgtttactgtatactctaataaatgtctgatacacacccacgcccacctgcacatacacaaatgctcatagtaattatgtaaggcaagtattatctccacatttcagacaggttaacttacacagctattatagtaagtgatagagcagaacttaaaaaccctgtatgattcaggtccaaactccttttctttctttatataaccataatatttcaaattaagtaagatttcctatataacgtcctgcctctcatcattatcatcaaaataattccccagaggtgtaggttcttaattaagcatttcttagtgcataactctattcaataacatttttcaatttaaggaataatctcatctcagctcatctgaggtgtggattaagtgttctttaagcctttatatacacgtgatcacatacggctcgttttttctgcttgggattataaaaatctccgtaacaccaaatacagcttttgaagtcacatataaacagacgttgacatgtatattaacaaacatatataaacaaggtgatttcacacgttatctacttaaaagagggaagtaaagtagttttactaaaatatgcgattatgcacttgccagctcacctgttagtggagccccatgaaatgtctgtgacccctgatatccatcaggcaccgagtctggtccataattctctgtgggccaacgatgacgggatgctgacttactgctatttagtttctattggaagaaaaaaaaatcaaataattttaatcatttaattatatcatgccagaaacagtgctggggaaacttactcttttaaatttaaataactgattttttctttttttcttttttgagatggtgtctcgatctgtcatccaggctggagtgcaatggcacaatcttggctcaccgcaacctccacctcctgggctcaagcaattctcccacctcagcctcccgagtagctgggattacaggcgtcagccagcacacccggctaattttttgtataatagtagagatggggtttcaccatgtttgccaggctagtcttgaactcctgacctcaagtgatccaacacctcagcctcccaaagtgctgggattataggtgtgacccaccacgcccggacctgattatatcttttgaaagtttctatttgccaatgagttctaggtacctggtgctgattttaaaatatgattcttaatttgttaaaaatttatctgctcccattttcattcgttaatacaaaacctaattcattaactctctcacctaaacaaataacctcctaaatgatcacaccttcatttccattctacacttgcctacattaacctttctgacattcacctccagccaagacaattccctgctcaaaaaaacaagtacctacaaactaaacttctttccccaactttcacagtcctctaacattacactgaccatcctttcagtgtgttctttctatactgcaatctggactacctgacattccaaatcacctccccaaattagcttttcacttaaccccatgctgaaacaaaatacaactaattctccaggtgacgttcaaatgctccaccaggaaagggaaaaaagcagtagctgcagataatttattatgtatataataatacgtccaatgcacttaaactcttaatttttatactatctacactgttaggtaaacaatattagctcctatcttaaaatgagagaaagggatgcagggaataacagctggaatttgaaccacatctgactccaaaaatgttctcttaacacaactctgctgccttgacaagatggcagatagatacaatgccgtctagtgtagctatgtggctacctgatctctgctgaagaaaactaaatgacagcaccatacccaaccctagaacctacaaaatgtccccttacaaaacagacacttaacaggaaattctttttccaaagaaattgtagtggtatcagaaaacaggtaaattttgaaaagtttcaaacttctctgtatcagcccaggaatccgaccagttctaacaagtgaggtcagggacagatctagcatgtctgctttctttttctacaagtgtttcaaataaaaatttcccagaaagacctaaccatgaggtccaaaactatctcaattttcaagctaaataaaatttcccccactcatccatctacagtgcctagtccagatgctacacatacacatccaagaaataagaaactagtggaatcacctagaaaactttatggtcactgttggtatccgcaccagagctttgaatttgcaatcactgctgtaactgtaatttttaacattcagtgtaatgagaactggcttcaataattctctcattttaaagataagaagccagtcacgaaggaagtgactggcccaagatcattaattaatggcagagtcagtactagtaccaagcttttcaagctcatggactagtgctccactatacttccacagaatacaatgttgggagcctgaaacctgtatgttaagtcaaaattgtatgtaattgtcataggccatgactacacagaattaacattcaagatttttgtgcaaattcaaaaatgtcttccccaccaaatagtattctcttaatttgcaaatactgctgatcacactgtaataatcgccacacatcagcatatccttgatgtaactttagcagtataatttagttcttgcctgataaacatgaaagaacctacttttatttccaattccaaaaaagtcaagctcctttgaaccctattgttaaaataagatatatatacataactatttccttacataattaagtcaaattcatatggaagtattaaaatatagcaagactttttgaagctcagaccacttttcaattcctagctatacatttgaaacacatgtaatccacagctaatctgagaatgaactcatagaccagagtatgattagtacactgtagcagttcaatcactcgggaaccttctctgtgtcaggaactcttatattttaaataaaacagtttctacctttgaaggtctcaaattttgtggaagatgaggagagagacacataaagtactttcaaaaatatagtaaagggctgggtgtggtggtttacacctgtaatcccagcactttgggaggccaaggcgggcagatcgcctgaggtcagaagttcaaaaccagcctggccaacatggtgaaactctgtgtctactaaaaatacaaaaattagctggtcctggtggcgggtgcctgtaatcccagctactcaggaggctgaggcaggagagtcgcttgaacctgggaggtggaggttgcagtgagccaagatcgcaccattgcactccagactgggcaacagagtgagactccatctcaaaacaaaacaaaacaaaatatggtaaagggtcaagaccaaggtatgtaggctgggcacagtggctcacacctgcaatcccagcactttgggaggctgaagcaggaggattgtttgagccaggagttcaaggccaccctgggcaacatggaaaaatcccatctctacaaaaaatacaattagctgggcctagtggcgtgtgactctctgtagtcctggcttcgtggcaggctaagccaagaggctctcttgagctaggaggtcgaagccacagtaagctgtgatcataccactgtactgcagcctgcacaacaagaccctgtcttaaaaaaaaaaaaaaaaaagaccaaaatgtccccttgccatactatttggatggcaaggggacattctgaccagcttcagaaaaaaagtgagagagtggccagggaaggaatcttggaataaaaagtacagctagagaaattaagtgacttaccgtaatggcctttacttcttggcaaatcattttccgtaaagaattctgatcttctgcccatcgaggtggtgttttgggagaatactaaaaaaaaaaataaaaataacaaaagagcatttaaaacacttagaaacaatttcacaatgaaatgattccattctttcctgtttaccttgtaacttttacttggtgatagtgaatatttggtaggagatggtgtagaatgttttatttctgaatctgcatttcgcaaagaaccatttttatagagaggacctccttcactatagtcttcgagttcctgcatgactgacttaagcatctcttttacagactccaggggcacaggcaactaaaaataaaagacattaattaagggctttcatttgcaaaaaattccaaaagtaaaaactctaaaatgatatattttatcttatttacatttttgtcattttaataagcactttacactttaaataataatacacgtgaaagtgttttttaattatcttttttctttgtttttctgctgttttgtattattatttttatttttttgtctttattctatttttttcttcatgaacacagaaaagtgttgtacaatctaacatcttctgattctaaagtccatgctctttctattacttctgttaaccatgataattgtagaggaatgttaacttggaaagcttttccaagtgaacaaaataagttactgatgttttctaactgattttcaatggtgacagaaatacagatgctacaatacaccagacaacataaatcctaataaaagagtagtaacacaaattaatcaacaaaacactcagaagactgaacataatttaacatcatcatgacaatctcaaacagctgacagcaagaaaacaagggcgttcataatggctgatgaggatgagaagaaatgctcttaagttgtcagcaacaactttcaatttcagcaaagttcattaagaattagtcctgaggttataatatttgttttgattacactgctaagataacacctagattcccaagtttaaaaagacacaccaaacctaagacaaagcaagcaaatataagcatttagacacacacatcccttctgtgcattaataacaacatattactgagtatttttgaaattaccaaaatataagaccaacgcaaaaacactgaccagtgggttatcagtaagaacgtacatacaacaacctgctacttactttcttgaccactgaaagatttgaatcactgtcatctataatctttattaggtagtccctggtctttctcagataatttttgcattcttcttgttcttcaggaaaaacggcatcattttcaatgtcttctgctttcctgtgaaaaatctatacaaatagtgcttttatgaaatcattagctttttaaaacaaaaaactttcagcttggccacgcatggtggctcatgcctgtaatcccagctactcgggagctgaggcacaagaatcgcttgagcctgggaagcagaggttgcagtgagccaagattgtgccactgcactctagcctggccaacagagaaaccccgtcttttaaaagaaataataaataaataaataaaacttttagctcaagtactgcatctacttaccagtgcaagattccaataagaaacaacactttttatagattcaaaagcagtcacagcatcttctatatttccatgtactgcatccaatatagcaaaagttatgtgtgcatcttcttcatactcaacaatttctgatgcctaaacacacagaatagtttttagtcaaattgtttatactcagaatataaaacccaaatgattttccaaagattttatatgatcttaagagacaaacatctcattactcttctctgtcatatcttatctgtgagagctagtgaatttagaaaacaagattaccgttaaataacaaggcaattaatttaagcagtttatagctccacgtctttgtttataaactggaaattcccatctccaataaattcataaaggaactctgttacctgaatgtctacactatgaaaatgtttaaacagaggatcaataggttcaggaatactgttcttctttattatcttcaacaatggcaaaactttcttccaataatgaacacttctccctatgtattcttgttgatcataagaagaattaagacccctgccctaaaaaagaaagttaaaagcacacaactttaaggaacacgcatgattagatctaaagttcatttacaggttgtaagaactggctaaaatttcaagtcaaaaccaaatggtacctcaatagtcatttgttcaacttccaaatactgtaataactaaaccaccttaataccagtgaactcactgcaacctctgccgtgcaggttcaagcaattctcctgcctcagcttcccaagtagctgggattacaggcacctgccaccatgtctggctaattttgtagttttagtagagtttttttttgtatttttagtagagacggggtttcaccgtgttagccaggaatgatctcgatctcctgatcttgtgatctgcccgcctcggcctcctaacgtgctgggattacagatgtgagccaccgcacccggcctctacactcaacttttaaacacttctaatgataccaccctaatgtagcaatcccaactactttttaacagttgccatttttagatagctgaaacctgcctcttctgtagtgtcagtttgttcaaaaggctgaccatcttcacctaatggtgacacaaaacaaaccttaaatatttagaaagatctataatggtcttacctacaaagccttgtgctaatttttttttttaattttcaggctgaataattatcagaacttaattattaaggaataacagtaacagctcagctaatatgtaacattcactgtgtgccaggcattgctcctctaagtgcttatatttaactacattaactattttgcagcaataaaaaacacatctgtcataatatgaccaagctgctgttttctgaacaaaaaaactttcaataaaaagtgcatgattttaaaaaattaaggtaatgttctttaaaaatgcttatactttaaaactcaccattttctgaaggcattttgcccaatgtacaagcagagcaggttgaaggccatgtttttcctgggctcttagagtgtttatttcatgctgaactacaagtctcaattctgctgagtttccaggtctaaaaaatacttcaatttactaaaattgttttctaaatacacagttcagcgcttacatacatatatgttaatgggtcacatgacaaattaaatcttcacatgaggattaaatccccggtaaaacctacgcactaagtgaaagcaatatttttgttttactacttacactgcttttctgtgaatcagagtacaaaccgcatcccaccaagatttttgtctctctgtacaaagccgtttacacacaggaaggggcaggcataacggctgataggagctgtggtgagaattacatttctcctttaattgtaagtggctggtatatactactccaaggagaaatacctgttttatttaaggaaaagttaagttagaaaaaaaaattaaacaaaattcagaatatttaatttgttaaaatctttgcttacttcaagatctaaaatacatattgattcaggtgcatttgtttcaagccttgaggtttcctggggcaaatgatggaaaagctgttttagccattttcggattccaggtaaagcaggcaatgaattccactgtaagccaagccaagtaaggtgctgaagactaccattatgtgcttgaatagcacctgaaataaaataaaaaaattggcttaagggttcgaaatttttctttgtgccattagttttgccaacataaacaattcacattatatatatcttaattatataactgcttttctatatcaaagctggagggaattctatgttaggcaaaatctcatgttcttattaaatgcattctcacttgattatttctagaaattttaataaaaatagtagtgatgaagaatgtttaagtccatcttaaaaaatgacactgactagaactcaataaaccaaaatcaactgacaaaagccaaataaagaacacctaacctaataagaaaccccaaaacaatgggttttcctttaagtcattaaagcaatggaacaccactatattaatccatcggtacagtaaagaaatctgtttttctacaagaaagtcaatattgaaaaggttatgtgcagtcaggagttcgagaccagcctggccagcatggtgaaactccgtctctactaaaaatacaaaaaattagccgagcatggtgtcacatgcctatagtcccagctacttgggaggctgaggcaagacaattgcttgaacctggcaggcggaagttgcagtgagccgagattgcaccactgcgctccagcctgggtgacggagcgagactctgtctcaaaaaaaagaaaagaaaagaaaagaaaaggttatgcgcttctggaagcatgaagaggtataatctttctgtcattttggcaatttgcaagacttaaagatgttcatgtcctttgtctcagtaattctgtttttaggtatctctatggaaataacttgcaatgaagacactttttgttgaagtttttatcagagtatgattattaacagtggaaaagttgagaaaacttggatgcccaataacagaaagttgcaagcaaattatgactacttcataaaaaagattatattgccaataaaagtgatatttatagttttaatacagagactatgggagagaattcatgaaggaagcaagataaatcatacataaacaaccatttagatgaaaaatatggtcagatgcagtggctcatgcctataattccaacacttttgtttttgagacgaagtctcgctctgtcgcccaggctgtagtgcagcagtgtgatcttggctcactgcaacctccacctcccgggttggagcgattctcctgcctcagcctcctgagtagggactacaggcacatgccaccacccccggataatttttgtatttttagtagagatggggtttcaccatgttggccaggatggtctcgaactcctgatctcaggtgatctgcccgcctcggcctcccaaagtgctgggattacagatatgagccactgtgccaggcctaatcccaacactttgcggggcttaggcaggaggatcacttgagcctaggagttggagactagcctgggcaacaaagggagaccctgtctctaccaattaaaaaaaaaattatctgggccgagtggcatgtgcctatggtaccagctactcaggaggctgaggcaagagaatcccttgagcccagaagttcaaggcagcagtgacctacgatcacgccactacactccagcccaggtgacacagcgagaccctgtctcaaaatacaacaaggctggtcgcggtggctcactcctgtaatcccagcactttgggaggccaaggcaggtggatcacctgaggtcaggagtttgagaccagcctgaccaacatgatgaaaccccgtctctactaaaaatacaaaaaattagccgggcgtggtggtgggcatttgtaatcccgctacttgggagactgaggcagtagaattacttgaacccgggaggcagaggttacagtgagccgagatcgcaccactgcactccagcatgggcgacaagagcaaaacttggtctcaaaaacaacaacaacaacaaaaaatacatgccacccctacagcaccacattcaaactccccccagcccaacccacacacaaaaggaatacaggaaaatattaagtcgttatttctgggtaataagattatgggcaatttataataattaagacggagaccatttcctctgaaacatataacttaccaacatcgtatctagccaaatcttcaagctctggttcttgtacatcaatgtttccaatatcatcgctaccaagaaaagatgtatccttagatgactgactagaaaacagagcattatataacacagactgcccgcttttgttggcaaaagtttcaacaacctcttttaaaaaatcttgcttgccacgacttaagtttagcaacatatgccctgaaaaaaaaatttaagttatttccatcactttaaaaatacagattgtatttgctcacgttgtctcatttgtatacccaaaggggaaataacatgattattgcagacctaaccctccaacccaaaaaatacagctggacaacaaaacgggtgcttatgtagcaaatgaaaagagtacaggtttaatattctcagtatctacataagacagcagaagggggaaaaaagacaggaatgtgtatgaaaaatgccaaacatatttgcattttagatgaaaaggtctggatttaagtggccataggagaacagggacaagctcttattctctgatctgatacactgatttctgaacctggctgatcagaatcctcctttaaacagcttttaagaattatttccggctgggcacggtggctcatgcctgtaatcccagcactttgggaggccaagctgggtggataatgaggtcaggagatcaagaccatcctggctaacacagtgaaactccgtctctactaaaaatacaaaaaaaaaaaaaaaaaaattagccggccctggtggcgggcgcctgtagtcccagctactggggaggctgagggaggagaatggcgtgaacccgggaggcggagcttgcagtgagccgagatcacgccactgcactccagcctgggcgacagagtaagactgtctcaggaaaaaaaaaaaaagaattatttccaggccttgttcccagagatttttattccataggtttacagtaagcaatcaaaaaatcatagtcctcggataaaatactgatacatgctataacacagatgaaccttgaaaaccttgctaaatgaaagaagccagtcacaaaagaccacatactacatgattccatttatgtgaaatgttcagaagaggcaaaccggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaagaagaggcaaacctacagagacagattagcggttgccaaggctgagaggtttgggtaaaatggggagtaactgctaataggtaagaaattcctcatggagtgatgaaaatcttctaaaactgactgtggtgacagtggtaatactctatgaacatagtaaaagccactgaactgtacactttaaatgggtgaagcgtatggtacatgaattatatttcaattcaactttttttaaaaaccctcctttgagttaattctgctgggcaattaggtttggttaccactacacagttgtgtctcagcacacttacagaggcaccctcgggatgcccagatcaaagacataaaaaaaaaatacaggcaattttcatctaactgtgacaccatgcaaaggcacttatgagagccctgcaagggtagaaggaaaagagaaaaggaaaaaagtagaaagtcactttaaggactgaaagcctagctcccacaaaaaaagtgggctatggaataaaagagcaatgtgagctttggccaacagcctaactatacaccaaagcttataataactttgatttaatattacatcttgctctttacaaaattcatccaattttatatcaaaactgctccttataggaagcattatgtttcttcagttcactgcttgattcaatggccatctaactaccttaaagtttgtatcttagcaaaatcacaggtaatatgcaacagacctttaggattcatcccaagccaaaaacgggggaaaaaaatccacaaattccaagagcctaatataaggtaagtatatatcttctatcttcctcactatgctctcagctctttaagacagatccgtatcttcttcatctttatatccccacagcagtgtttttagaatcagctggtgttaaatggttggcaaatcaataattatacttagttcaggaagtgactaaatattcaggctagaggctctagcagccagatgaagaaagagttaagaaatcctctccacataggaacaaacaatatcaaatattcattttttttaaagaatgtgctatttcttcgcatctcttccatacctattgctcttaactgatacggcaaaaagaaataattttgacaaattatctcctggacagatgaagattttatcataagatatgccttaacagaaattcctttttctttttaaattaaattagtttaatattactattacctgattggctcagtcggtcacaggccatcatttccagcagattttgtccagcttcaccttttattaatttaatctttggtcttggaacctaataattttagaatcaaaaatcttaatttgatgatacccatacttctaatagtaacatggtcttgtctattacactgtactttttttgataatgaataaacagttaaccattaattaaactgaattggaaaagactgcaaaaactgggaaccaaggaatttatataacctatgaaagataggccaggtacaggcgtggtggctcacacctgtaatcccaacactctgggaggccaaggtgggctgatcacttgaggtcaggagttcgagaccagcctggccaacatggtgaaacccagtctctactaaaaataataaaaaaaaaaacaaagaggcaggcgtggtggcacacacctgttaattccggctacacgggaggctgaggcacaaggatagcttgaacctgggaggcagaggtcgtagcgcgccgagactgcgccattgcactccagcctgggtgaaagagcgagactccatcgcaaaaaaaaaaaaaaagaggggccagacatgttggctcacacctgtaatcccagcactttgggaggccgaggtggggggatcacttgagcccagagttcaagaccagcctgaacaacacggtgagaccctatctctaaaaaaagttttttttattagccaggagtggtggcacacaactgtggtcccagctactcaggaggctgaggcaggaggatcacttaaatccaggaggtcaaggctgcagtgagccatgatcatgccactgtgctccagcttgggtgacagagtgagaccctatctccaaaaaaagaaaaaaaaaaaaaaagcatacacagagcagctctgagaaattagtttctactaaaagcacattcgtgttacattcagagaaatggaaaatttaattatattacttttctgccctgaataaataggacaacagcagatgttgtcctatttgagtagatatgacaccctactttaaaaagtacaggtgaaatgacacttggaaatgccacattgtagataacacattttcagagtatggataacaggggatagcactagaataaatgggacaaccaggaaattaaagagatcctaatgcaataacctatggaaaaaaaaaaagcatgatgaatagaatggcgaagggaagacgtgacagctgccttcaggtattaaaattattttataaaagaaatcatcaaaagaagaaacaagaccaacaggtagaaggcttgaagaatatttttattctatataaggaagtaccaagagccaaaccacctaaagatgcactgggctatcttgaaaagtaatgaatgcccatcactgaaaacgtccagtcacaggcaatgcccacttactagaaacatgccaaaagtaactatatgggtgactagagcatcggcttttaattctatcaccactttcttaattggtggtggaaatgtaatttgatacaacctctttagggttagatatttggcaacagctctaaaaattataaatgcacagatatactttgatactgcaattctttcaggaattcatggcacaagttaatcattgctaaattacttgaagtagcattaaaaaaaaaagtaaaagcaagctaatgtcctggttttaggaccctggttttaaaaactccaaaactacagtacatccatacaatggaataatatgcaagcatccaaactaatgagaatgccctttatatatactgacatggaaacatctccaagatacagttaatggaaataaagtaaatgcaatgttcaaatgttttcctccttcctttaaagacaggggatatatgtgtgtttacttggagatgcataaaacatttcctgaagaacacacaagaaagcaataacattagtttctttggggctggagaaagtaaataactagggaacagaaaggagtcttcatagcatattcttaagagccgccagaattttaaaccatgtatatataattctttccaaacatgctcatttttcaaaatatatgatttatgaacctaaaagcttctgattttgaattttagaaatattcatatcgcctatccttttactcacaagttttctaaacatcatgtcaaagtttgtcatctatatgttgaaaagagcacacaaagtaagaaacaaaatgttgacatcattctttttgttttcaaactgacctcaattcataaacccggcctcttttacaaaattattcaacagttgaatctgtgaccagttaattagttgtgaatccactcaatcaaatcatctcaattcactatttcctcttttttttttgagatggagtctcgctccgtcgccaggctggagtgctgcagtggcacgatctcggctcactgcaatctccgcctcctggtttcaagcaattctcctgtctcggcctctcaagtagctgggactacaggcacctgccaccatgcgtggctaatttttgtatttttagtagagatggggtttgaccatgttggtcaggatggtctcaaactcctgacctcaagcgatccgcccgcctcagcctcccaaagtgctaagattataggtgtgagccaccacgcctggctatttcctcatcttaactaaaaggtttcaagatactttgttaactacctagctgcaatgcagatgcacttactagaaccacagtattcctctgattaagagtctgaaaatcttgccataaaagttagccaattcttaaatacccaaatgccagcacataacctacattttatgcttataatcatttgttcattaagctttaaaataaactgatcaaataaaatacaagcatctaagatgtttctattatatattcattctacagaaatatgtggtagctaataaagactgaggtaggtatctctgtgctgaagtggaacaatgaagaaacattcagaaaagcaaggcatctggcaataggtaaagcacacccacattgaggcacaatattttttaaaagcagagaaagaatgtattgcacatttgcatatgcaaaaaatatttctgaacacccaagaaactcctaacagtagctgtcatctaggaaaggagacctgagtgaatggattaagagggaaactaacttattatgattaaaagttcacagtcaggtgtggtggctcatacctgtaatctcagcactttgggagggcaaggcagaaggatcacttgaagccaggagttcaagaccaaccagcctgggaaacatagcaagaccttgtctttacaaaaaatttaacaatgtagccaggcatggtggcaggcacctgtagtcccagctactgagctgaggctgaagcaggagaggatcacttgagcccaggagttcgaggatgcagtgagctatgatcatgccactgcactccagccagagcaagagtgagactctgcctcccaaaactacatatcgaaaaattttaggctgtgcgcagtagctgacacctataatcccagcactctgggaagctcgagcccagttcaatgttacggtgagctacgattacgcaactgcactccagcctgggtgacacagcaagactctaatagacacacagacagataaattttaaagtttccattaaaaataagaactattggcagggcgcggtggctcacacctgtaatgccagcactttgggaggccaaggtgggcggatcatgaggtcaggagatcgagaccatcctggctaacacggtgaaaccccatctctactgaaaatacaaaaaaattagccaggcgtggtggtgggtgcctgtagtcccagctactcgggaggctgaggcaggagaatggcgtgaacccaggaggcggagcttgcagtgagccgaggtcgtgccactgtgctccagcctgggcgacagagtgtgagactccatctcaaaaaaaaataaaataaataaaaataagaactatcagttacttgagaatttctataagaaccttttaatgtttgtattacctagtgaacctcactaaatccattaattttcactaatccattccttatgaacacagaagtttctactgagccaatattagcatttaacatgtgaactgtctatcaacggtgtttttaaaagatttacaggccaggctcaatggctcatgcctgtaatcccagcactttgagaggccgagtcgggtggatcacgaggtcagaagatcgagaccatcctggctaacatggtgaaaccccatctctattaaaaaatacaaaaaattagccaggcatggtggtgtgtgcctgtaatcccagatacgtgacaggctgaagcaggagaatcacttgaacccaggagacacaggttgcagtgagctgagattgcgccactgcactccagcctggtgacagagcgagactccgtctcaaataaaaataaaaagatttatattaggcagggcatgctggctcactgcctgtaatcccagcactttgagaggccgagacacgcagatcacctgagttcaggagctcaagaccagcctgaccaacatggagaaacctcatctctactgaaaatacaaaattagatgggcgtggtagcgtgtgcctgtaatcccagctactcgggaggctgaagcaggacaatcgcttgaacccgggaggcggaggttgcagtgagccagatggcgccattgcactccagcctgggcaacaagagcaaaactctgtctcaaaaagaaaaaaagatttatattagaaggaggggccttctctaaaagtaatgaatccttttttttccctccccaagcaaaaaatccttctctaaaattaatcatttttctaagcctggtttaatgctttttttggaagactgcttatttcttttcctttcaaaagttatgcaagctcattaaaaaaaaaagtccgggaatggtggctcacgcttgtaaatcccagcactttgggaggccgaggcaggtggatgactaggtcaggagattgagaccatcctggctaacacggtgaaaccccgtctctactaaaaatacaaaaaaattagccaggcatggtggtgggcgcttgtagttccagctactcgggaggctgaggcaggaaaatggtgtgaactcgggaggtggagcttgcagtgagccgagatcgtgccactgcactccagcctgggcgacagagcgagactccgtctcaaaaaaaaaaaaaggccaggcacgccaggcacagtgcctcgggcctgtaatcccagcactttgggagaccaaggcaggtagatcacgaggtcaagagattgcgaccatcctggccaacatggtgaaaccccatctctattaaaaatacaaaaaattagctgggcttggtagcacgggcctgtagtgccagctactcgggaggctgaggcaggagaatcacttgaacccaggaggtggaggctgcagtgagccgagatcacaccactgcactccagcctggcaacagagagagacttggtctcaaaaaaaataaaaaaataaaaaataagaaaaggttttatgttttcaaagattaatagatatactgttacatatacacaatacagccataaatgttatatacatgtgtttcaattaacatgttaaattgcaatcatattcttctatcataggctataaagccattgccctacatctacttattaggattttgtccaagtaacacacctttttgaatcaagctttacccataatacgagattacatctttatcatgttcccaaaaatggcagagtaaaaagatcaaactcttcaaatttgtctacaaacaaatcatggcaatgcaggctttcgacaagagtgcactcaacatccctgtttcaccagcctcaccagtattgtgtatgcttagttattttccactgtatcaaattgactatttcattttaattccacagtttgttcacatattgtcattacataccagagcacaccttcatttaaaacacatcaagactccgtgaaatgtcaattgctcctacaagtggaagacttacctgaaatgctatgacatagcacaatgcagccagctcagaaagagcttgccattgaacattattaccatgctgacccatcttcaagagcagagaaccagcatgcatgtagaaatgtcctttcatttctaagaaagtagctgacagttcatcatttccacccaaagaagattttgcagactgaagagcactatcaaaactgtaatatgaaaatatcaaacagatgatacacacttactgcactgtgaataatcatggttcatttaattcaaaacaaaataaaaattttatttcaagcttcatcttccacattcaacttctaataattcttattccccatgttataaattatgaatcatctaatgcttatttttatcctgcatacttcctatacttcatgcttaacctctcaaatgatgtcttattcccagttatttccagccctccaatcacaggataaatataagattagtgattataggtgcacatttcaaaataaaccaggataaagttgggagactattttgtagtttcttcctgatcatataatttcattatttaattaacagttgtaatttctcaaattagacataccatttccaaattataagtaagtaactgacaggtatttgagtatcaatacagcaattgctctttttactatatagatcattacagcgttaaattgttttttttttttttttttttttttgagacagagtctctcactatcgcctgggctggagtgtaatggcacgatctaagctcactgcaacctccacctcccaggttcaagtgattctcctgactcagcctcctgagtagctgggattacaggcacctgccaccatgccccgctaaactttttttatatttttagtagagacagggttttactatgttggccaggctggtctcgaactcctgacctcacgatccgcccgcctcagcttaccaatgtgctgggattacaggcatgagccactatgcctggcctattatttgtaatctatattctaaattagttcttctaaatcctaatgtttctccaaatcctcactttggaagaaaagtaaaagcaaaaagcaaacacttaaacgtgaagcatgattttaaagtggcttacaataacgcaaccagagcaaatgaggtctaaagatctctgagggtgctcaaaaaccccttcaggggatccatgaagttaaaattacttttacaataataccaaaaaaaaatttatatattacatactcattttctcatgtatgtagagctgagtttttttgtttttgtttttggagacagaatctcactctgtcacaaggctggagtgcagtggcacaatcttggcttaatgcaacctctgactcccaggttcaagcgattcttctgcctcagcctcccgagcagctgggaatataggcgcgtaccaacatgcccggctaattttttgtatttttagtagagacaaggtttcaccattgttagctgggatggtctcgatctcctgacttcgtgatccacccgcctcggcctcccaaagtgctgggattacaggcctgagccaccgcgacccgctgagctgagttttctagaggcttcatgacatgtaatagttttacagactgaaagaggaagtaaatgagaatctagctatgttctattaagcgagacattaaaaagatttacaaaaatgcaaaaacaatgacacttttctgactacttttttgctgttggaaaataattatttttcataaaaaatgctattattggccctgcgcggtggctcacacatgtaattccagcactttgggaggctgaggcgggtgggtcacctgaggtcaggagttcaagaccagcctagccaacatggtgaaaccccatctctactaaaaatacaaaaaattagccaggcgtggtggtgggcacctgtaattccagctacttgggaggctgaggcaggagaatcgcttgaacctgggaagcagaggttgcagtgatccgagatcacactgttgcactctagcctgggcaacaagagcaaactccgtctcaaataaaaaaaaaaaaaaaaaaaaaaaaagctattattattaacacacaatagggcttattacatttttaatggattacattttttatttgttttaatttctaatgtaataaacactgacagaaataacccacatacggccaggtgcagtggctcagacctgcaatcccagcactttggaaggccaaggcaggcggatcacgacgtcaagagattgagaccttccagtactttgggaggccaaggtagacagatcaagaggtcaagagatcgagaccagccgggcgcggtggctcatgcctgtaatcccagcactctgggaggctgaggcaggcggatcacaaggtcaggatatcaagaccatcctggctaacacagtgaaaccccatctctactaaaaatacaaaaaattagctgggtgtggtggcgggcacctgtaggcccagctactcgggaggctgaggcaggagaatggcgtgaaccctggagacagagcttgcagtgagccgagatggcgccactgcactccagcctgggcaacagagcgagactccgtctcaaaaaaaaaaaagatcgagaccatcctggccaacatgatgaaaccctgtttctactaaaaatacaaaaattagccaggtgtgggctgagcgcggtggctcacgcctgtaatcccaacactttgggaggccgaggagggcagatcacgaggtcaggagatcgagaccatcctggctaacagggtgacactccgtctctactaaaaatacaaaaaaattagccgagcgtggtggtgggcgcctgtagtcccagctactcaggaggctgaggcagaagaatggcgtgaacctgggaggttcacaagggggggtaacaaagggcccatgagtcctgattaactgatctgacaaaccatctgtcacccaccaccctaagccacactgtgaaactgcctagggtggcaccagctttttatcttcctcagggtcctcccctcaggcccccaagtcaccccctcatggtccggattctcccctgagtgactccatccccatggtcatctcccctcctgagcctccccctctgagggccaagggctgtcctcagggccctcctggggcttcctggtggggaacaacctgaggcaggaggataagctcttattcagagcattgagaggaaattgtgaagcttgcagtgagccgagattgcgccactctactccaggctgggtgacagagcgagactctgtctcaaaaaaaaaaaaaattagccaggtgtggtgtcgggcacctgtagtcccacctattcaggaggcagagacaagagaatcacttgaacccaggaggcagaggttgcagtgagccgagactgcaccactgcatgccaacctggcgagagcaagactcagtctcaaaaaaaaaaaaagagagattgagaccatcctgaaccccgtctctactaaaaatacaaaaattagctgggcgtggtggtgtgcgcctgtggtcccagctactcaggaggctgaggcaggagaatcgcctgaacccgggaggcggaggttacagtgagtcaaggtcatgccactgcactccagcctggtgacagagcaagactccatctcaaaaaaaaaaaaaaaaacaaaacaaaaaagaaagaaagaaagaaaaaaaggaacccacatacaaagatctttgatgtccttaagaaaaatgtaaaaggaacttgtgaccaaaaaatttgagtatacaaagaacacaaaataaaacatcctacatgttttctaaaataatcttaaagttatgttagttcttttagatactgctcttaccctaccaatttaggacactatgtactttttcaagaaaattacctactccctgcactcagtgaaatgaacttctttccttataccagatggggaaataaattaacttccaaacaaatggacagcctaaactagcaatcagtaaactttttctacaaaaaggaggagattactaatctggctttacaggcatacaatctctgctgcaaccactcaattccaaccttgtagtatgtaagcagccacagacaatacataaacagaggcatgttgcattccaataaatattaacaaaattaggcaggggccatatttggcccacaagttctaaccaacccctgctctaaactaacatttttatacaaatccaagtgatgtttttgttcaatggaatttattttcaaaatggagacactggttttcaaaatcaaaatttaggaaaaaaggtaaatcacatagttgagttattttgtttcttagctaaaacagtattttctgaaataccagtgatgctaagtgcttatactagtacatgtgaacctagccatctgatgacagatgaaccttaattttcactcaagattatactattataaaaaataaaatatgaaatagcagttagaacattcattttaagcttgactatgacaaacctgagtatttaaccataaggctaattttaatcaagcttgaactataagagttctctaaaaaggaaagtcatataaaaccaattagaacttccccgtaaaagaagaaaaataagattgcctcctagtggttcactgtattaactataactcctaggtacattatagaaataatgatgcagtaaagaaatttagagcaatgaacttactgcaaaaagaaaaactacaatttatactaaagcattctcctcaaagtcaacgcacctttccagtaattctctactttcctgcacatctctagtggaaagcgtaagaagcataagattagcataggccagcagtaagtctgtattggttgctcgccagtcacttttatcagactccaaacactgtaaagactccagatattcctattttgtggaatgaatagtaagttacaaaacttaatcaagtgttaagaaattaaccattttatgcctacaaattccttttctcactctaaccacgtttgtgaaactacattgatttttacatcaaccttataaatgaaaacaccaaaaatatatacatttatcatagttatctccccaactttcccattataaatttaactgatcctggtaaaaatttcattttataactgttctacctaaataaaagaaatttaagtcctgcggggcactgctgctttagtacaaaaagatgtatgctaattgcctacatagaaatgtaaagacccaatagcttttatctaccttaagggtctgtacaacacacgaattccactctaaacttgaacgcaaagctatgttcctctctgcctcatggcagcgggccacagcatccttcaatcttttatttgagcgatacaactccactagccggatgttcatatggacgtcatcaggtcttacataaagttctgactgaatccagtcaaaaagtttattccatccatcttcaccttcacaatctagaagatgttcctatttagaggggaaaaagaaaaattattagagtaacacttgtgcaattttaaacaagtcatgctcccaaaaagcaccattccactatgtctagttttatgatgatgccaccaaaaacaccatcctatataccttattcgtcccttctgagagttgcttacaacccagaaactaagcctcaagaactgtatgtgaagaaaagcatctgtgattactgcagtagcttatactctcttcagagactaccaggactattgccacacatccctgtccatctgagtcaccaccagaagcctagacctccccagtcaatcctcagcaacaaggtccttatgctcaaactgctctgtatctccttaaatctgactcaatcccacatcccctctcctcccactgttctgttaccttcatcatcatctcaaagcactgtcatcacctcctgatcttaaatgaagacagtatcatctcaggataacccccactaccatgatggctttttctctctgaacttacatacaaggagaggaagtagggtttgtggccactcgcttctcatttgcgatgctcttccatcagcctctcaagaagctaggaccataggcatgcaccaccatgcccggctaatttttttttaacgttctgtagagatggggtcttgccgtgttgcccaagctgactactcagttccttaatcacctcatctccagtcatgttatcctctactccaacctcaaccatccacttgccactgacacaggtcttcaaaatctgcattttggtcataccaccgaaacgaccataccatccttcttattcttccacctcactgagggcctacgtacccttactttcagaaatatacttctccaccacatgacaagttcccttcaagacaataacatcatcaagttttaagcacctgtaaacacatataaatacacacactttcttctgtcaggcaaaaaatgctataatcccttatatccataattactgtttgcttacagatcccttcaactaattccctcttttcctcagaaccctcccaactggtttctgtgtgcttagatttgggaaatcataaccccaagctaaccgatttcatttgcattatctcaaccatcaaactggtgctgcctaaaacaaaatgccattttagtactaacagactcactttctccactccctgacacttcacacctcctcctatttcctcaacttccccataccttcctttgaccctcactttcaacttataacctagattcatccttcactgagaaacctgatgctatcacatataaattccattttaccttacctacttaaactcgtctttccccagctctcaagaccaagccgtccattactactctgtatttcattcccctctctcctttatcaatttctcctcttctggatgagatggatgataccctggtctctccctattgcaaaagccctagtctttgactctatgttaaacattttttaaaaaaccactatgagtgcttttaaaaagttctatctcatacttgagagaaaaagccttctcaacagtaatactctcattcattaaacaaatgtcagaaactgtttaccttagcaagccttaaattttaggagaaatggaattactttgcatgacaattataaatctcatggatttcaattccaaaaaaaaaaaaaaatctgatacaggaaaggtgttaacagtgccttcaagttattaaagaaaatctttaaagagtgcttcaaagtatctaacttgttacactgcaagaaaacaatctcctgccattacatatgttctttaacactactgacaccagattaactggattgccacgcccaatatgggagttatgtttgaggcataacacctaagagagtaaagaaatctgcacaattagacctcatgttttagactaatatttaaaatccagctgcttattactggggagaaaaacttatcagtaatatttatctttggaagcatcttcaatgctttttcagcttcaaaaatctggacatgattgttcatagcagttgaacaacagccaaaacctagaaataaccaaaatgcccctcaaaagtgaatggttaaggctgggcacagtggctcacacctgtaatcccagcactttgggaggccaaagtgggtggatcacctgagaacccgggaggcagaagttgcagtgagccgagatagcaccactgcactccagcatgggcgacagagcaagactctgtctcaaaaaaataaaaataaaaaaagtgaatggttaaattgtggaccatgaaatgctactcagaagtaaaggaaccaactatggatatacaaaacttaatatggatcacaaatggtattatgctgactgaacaagccaacctcaaaaggtcacatgcttggctgggcgcggtggctcacgcctgtaatcctagcactttgggaggctggggtgggcagatcacatgaggtcaggagttcgagaccagccaggccaacatggtgaaaccccgtttctgcaaaaatacaaaaataagcgggacacggtaacatgtgcctgtagtcccagctacccggaaggctgaggcaggagaattgcttgaacctgggaggcacaggtggcagtgagccgagattgcgccagtgaactccaacctgggcaacagagcgagactccgtctcaaaaacaacgaaaaaagaaaaaaaaaagtcacacatttcatgatgacatttacataacattttgaaatcaccaaagtataaagatggagaacagattaatggttgccagaggtcaggcatagtgaagagaagtaaatagcatgactacaaaaggggcagcatgaggaagatctctgtggtaatagagtagctctgtatcttgacagtagtggtggtatgaatctacacatgataaaatgaaagaaaactatatacatacacattgtaccaatgtcaaaattcctgattttgatattgtgctttggtcgggttaaacaggttgagtatcccctatccaaaatgcttgagaccagaagtatttcagattttgaattttttcagactttggaatatttgcaggatacttagcaggcagagcatcccaaatctgaaaatctgaaatccaaaattttccaatgagcatttctttgagcatcatgtcagtgctcaaaaaatttcagattttggagcatttaggatttcagattttaaatgctcaacctgtataagcattggggaaaaatgaagtagcatataggatctttctgtgcaatctttgcaacttcctgtgcaaaaaaatctataattatttcaaaattaaaattttttaaatttctatcagaaacatatacaatgggggtaggaggaggctaaaggcaaatatacatttataattttatattgtacatacacaataaagtatacattaatatataaaatattacaatatacattttaaatgtttgccaaacatatttgtgtagattttctccagaacagttacttagtaaactatattttgctctataaagaatatcaggaccagtcaatacactagcaagaacttcctaccatttttagtaattacatcttatatactagagaaaccaccttttatcttttccttgaaaactttactatctcaaaatacaatcccttctactttcagaccatagttattagaaaactcttctttaaaatatccctaaattgtcatcctgtaggtaattttcacttaatgaagcaaaaattgtataccagacagaacttaatgtaaatcttagctctacttagtttacagctactaaactgtaaaatccctaaaatattaattattccagaagggtaaatgagatgtcacttataaagtataacaatgcctaataagacagcagatgctcagaaaggttttaatacactttttaaaagaaaaatgttaaaggaaacacaaacacctgggcttaaggtttgctattgaaaagtaatttaaactccaaatattagaaatggttatgtcttaagttttctccctttatgttttgtatgtttacctttagtttataaattgcaggacttcctgggaaaagtttcgctgccctttcaacccagtattttgctcttccatcagtaacatcatttttacaaagcaattctgcaatcttcaacacaagatctttttgtggtgggtttaattccagtgaacgctaatatcagaaaagaaattaaagattagtaaataaattgtatgtatgtatgtaggagtatatatacttatatacttatatataaaggttaaaaattatcactccaacccttaaaaaattctacttctagagaaaacatgttacttcaaaggtgttaaaataaaagtgtcttggaattttctggaaatgaatcaaataaaaattatatttgtgtcatttgaatgcaaaagaacacaaaagaacaccatttctgaccatgttagacttacaatttataggtgttaaacaattctaaatctgttccaagctgtgtcacataattgtactatgataccaatgcctgttttatgatattcataaaatatatttgacttacttatataaatttctctgggcatcatgtgtttggctatgcaaaggctatatttgaatcctataacttaccctgtaacattcaacggctttctctgtgttttcttccaattcataaagaagacccagaaatctgtgagctctgggatccctctcttgcacactaaggtaagtacatacgtatctgtttttcaaaagtaatacaaaagtaaattaaacttagaactgtacttttaaatgctaaccgaagaatacatcttaaaccaaagcaaccactaaactcgtttatattgttactcaaaactaccactatttatgcagataactcagaagtattcatagaaagaaatgggtaatacttaaaaacacgtacatagagttgaccacatactcgttttaccattaaatgtcacatttaccaaatttttctccagtgttatccacgcataagaaatgaacatataaattgctttttcttcctgatcacattttaataaagcactaacagttttgcaaataaattagaagtgattatagtaaacatttttaaagttatcataatgcaaaatactaaacagcaacaatttcccaaacaacaaagggaaatacacctaccctttaagcaagaaagtaatttctaacagtactatatccagctaaaatcgaacagaagacaaattactaattacagtaccaaatacaggaaatttccatttctcaaatcaagtaacaactaaaataagtaaatatcctctaggttccttgacagtattaccatcagagaaattaggccagacccaaactaagggattaaagtctcacagtaaaaaggtacaagagttaacagtcacagtgctgctagttacataatttatgtaccaccattttcctttcttaccagcatttccatcttcctttggatgcctttaaaagcctgcctcccagctgggagcagtaacacacacctgtagtcccaacagtatgggaggccgaggcaggcagactgctgtgctcagaagttcaagactagcctgggcaacatagtgacacctgtctctaccaaaaaatgcaaaccttagccaggtgtggtggtgctcatctgtatccccagctacttggggcgctgaggtgggaagatctcttgagcccagaaggcagaggttacagtgagcaaagatggagccagctgctgcactccagcctgagcaagagagacagatactgactaaaaaaaaaaaaaaaaaaaaaaaaaccctgcctccctcttaatttcctgctttaatccactcccagtcaggaaatcagaatcaccaagcttcttatccctaggatagagccttagagcatcacatattgtgtcaattaaagatcttttatacaagctattctcctgccttacaattacagttttttattcattgctattttccatctgattaaggtatcagatatctaaccaaaaacaaatgaagatataggcatggtcctcttttactccaacagaagacaatttttagaaaaagtgttttaagccaaacaatttcttgcccttggtataaagcagcagcatgcagaaaacactaattacggtttcaatctcaatggaatctaggctggtccttagcatcagtctgagtgataaatcccttattccagaatacacttaggaagaactactaagaacatatttttacctatttcaaagaagaaaatgagaaaaggcattgattttaaaaaaagaatacatgttacagtttgtacttactttttagcaagatcatattctttagcttcataatacagctttgcaaaatagaatcctctcaacttctaaaaaaaattaaaagttgttttacgtttcatacagaaatattttccaacattttttcaaaagtagtaaaaatctgccctaagtttatgttcaaatatgccattttcattcacttaaaagttttttttaaagcctgacaaatgcataattccatgttttataatttcctatcacaaaacaaaaaatagagctgggtgcagcggctcatgcctgtaatcccagcactttgggaggccgaagtgggcggatcacctgaggtcaggagtttgagaccagcctggcgttataacatggtgaaactccgtctctacaaaaatagaaaaattagccaggcatgatggcgggtgcctgtaatcccagctactcgggaggctaaggcacgagaatcagttgaacccaggaggtggaggttgcagtgagccagaggttgcagtcagctgagatcgtgccatcgcactccagcctgggcgacagagactccatctcccaaacatcatcatcatcgtcatcataaataagctgggtgcagttggtcacacctttaattctatttaattctagcactttcagagaccaaggtgggaggctagctttgaggccaagagtttgaaaccagcctgtgcaacacaacaagatcctgtctccagggggaaaaaaatagccaggcatagtggagcatgcctgtgttcctagctactcaggaggccaaggaaggagaatcacttgagcccaggaggttgacactgccgtgagttatgactgtgacactgcactccagcctgggtgacacagggagatcctgtctctaaataataaatacataacatacaaaaaataaattcaagaaagcaagacaagcagacaacagaagttaagaattttcatcagccttggaaatcttggaaaccctgtggtaccactctctcacttaacaaacaaaagaaaccagctttctttggggaggaaaggtattccagaaatctcttctcctaccatgtgtaagcctctatgggaaagaataagtaagtacttacgatctattaaggcactgaggattccctgtgccttaatagtacatgtactgttctctctacagatcagatcagtattttacagtcaaggagtcaaaaaggcagaaataaatattgaattcttcaagtaataaacaaggtccacagcctggctccttggttacgtaaactccaaagtccaaaatgctgatgcacaccaggctgggtgcggtggctcacacctgtaatcccagcactttcggagactgaggcgggtggatcacttgaagccaagagttcgagaccagcctggccaacatgcagaaacctcctttctactaaaaatacaaaaattagctgggcatggtggcacacgcctgtaatccccgctgcttgggaggctgaggcaaagaatcgcctgaacccgggaggcagcagtgggccaagaccgcaccactgcactccagcctgggcaacagaatgattccatctcaaaaaaaaaaaaaaaaaaaaaaaaagctgatacaaccagagtatgttccatccatgtgataaagagtatacagccactcaaacatcttatttttgaaattccaagaccccagtgaatgtccaaaacgatgaacagtatcaaaccaggttgccatcaatcgaaacatgtttcctgtttgtgtcctccacccacaaatttaatgtcttgtccatctcaacaaagcacttatcacacactgtggctgtaacttttgcagtttggggtgtcacaacaaaactagcacaaatttctttttccttcttcacaatttcatggacaaaagatttgttcttaccgtagatcttagcaaccccagtatacgatcttttttctttcctaagtcaaaaactcacctcttcacttaaaggaagcactatatggcttctctctggcatatgtgaactgccagcatcgctattcttgctctttggtgccattttaaataaaataagggttacttgaacacaagcaccgcaatactccaacaactgatctgataactgagatggctagtatgtaactagcgggtggggagcacatacagcatgaatatattggacaaagggatgattcgtgtcctgggtaggacggagcaggaggctgtgagatttttatcatgttattcagaactgtttgcaatttaaaactcatgaaatgtttatttatataatcttccattcaatatttttggaccacgggtgacgcaggtaagtaaaaccacgtaaggcaatactgtggataagaagggactactgtaccagcaacgaacaatcagaaaaggaaattaagaaagcaattccatttacaatcgcatctaaatgaaaaaaatgcctgggaataaatgtaaacaaggaggtgagagacttgtatgcttaaattacaaaacgttgctcaatgccaggctaacacctgcaatcccagcactggcgacagagcaagactccatctcaaaaaaaaaagaactatagcaatcttaacaaaaataatacacaacagtcaggacagcacataaaggaacaaggcttgttccccgcttcctttttttttttgagatggagtcttgctctgtcgccaggctggagtgcggtggctcgatctcagctcactgcaacctctgcgtcccgggtacaagctgggactacaggcgcacgccaccatgcccagctaatttttgtatttttagtagagatggggtttcaccatgttggccagatggtgtcgttctctcgaccttgtaatctgacttcctccgcctccgaaggtgctgggattacaggcctcagccaccgagcccggccagttcccccttttcaaaatgaagaaatagattcaaggtacaatgccaaaacataatagaaaaataattccattaccttctttgcttccaactatgttattaaagtagacaatcttaagataattaaacaactttacaaattattcttctgtatgatcttttgcctctaacctcactttacaagggaactgaagctcaagcaggcaaatgccttgtttaaagatatacagctaggaaggagcacagcccacgttatgtaaacaggacaatatctgattcaagcagtacttctttacatgacagcagatgtcactataagcaaatacctgaattcacttaagctgccaaatatcaagaactgatgcagggctgaaaacaggaacagtaagaccctaagagatgccacatcatcgctatcttgcacagtaagatagagatgtaattgtaattgtccaaaacttaacatttgtggcctactttttcattatgcagttctaaatttctctctctttttttttaattcaaacggagtctcgctctgtcgcccatcttgcacagtcaaatgaatctccctccccctaaaatcctccaaaaaagctgctgttctcaacaaacccatctgatcagctccaaatctgtggagtcccaacaagggtgaaggccgtgattatacaggacaatgaggaaaagtctagatactgaaacatgaattccccagtcttcttcccctggaacataagggtaaggaaatctctcaaaaggcagaacaaacaaaagaggagaataagagaaaaattagagaaactccagctttcaggtaaacatcattaaaaaaaagggtaagaaatggtcaaagaaataatacaagaaacgctacagaactgaaagaaatgagtttcccaattgaaaggacacttccagaaaacctttgttaccaagaacaagactctcatcagactcctaacaacagaacttctggaaaatggagcaatgctttcaaaattgcgaaaaaaattatttcaaactcagaattcgataaccaaatgatcaactaaattaagtaaagatgttttaaagacataccattagtttccagaccagcctgaacagtatggtgaaattccatctctactaaaaatagaaaaaattagccgggcatggtggcgcacacccgtaatcccgctactcgggaggctgaggcaggagaatcacttgaacccgggaggcggaggttgtggtgagctgagaccatgccactgcactccagcctgggcaacagagcaagactctgtcccaaaacaaaaacaaacaaaaaaacctctcatccacttttcctcaaagcaagtgaactatgctacaccaaaacaaagaaagtaaatgaagatgacatgagatacaagaaacaaagggtctaactcagaaaaaagatgaagggaattctcaaactggtgataaagggaagtcccaagagcacagctgtgtagcaaagaggaagaaaaaccaatctgggttggagaagtcggttagtaagggtattccaggtagacagacaatcaatcaatcaatcaatcaatcaatgttttaagctgaaattgatcggattatgtgaccagtttgaccacatttgagggtttaagttgctgagtttaagtaaccaagtagtaacacaacatacaagcaaaccaaaaaataaagcaattattcagtccaggaaaaacaaaactgcacaacaagggcaattcaaatgcaaaatatttaccttatatttatataaatgttaaatattcatttaaacaaaaactccaataacagtactgaaacaatgaggggcaaagcaaagtgtctgaggacagttttggaggagcataatagccagtacagaatgtctaaagtggggccgggcgcggtggctcacgcctgtaatcccggcactttgggaggctgaggcgggcggatcatgaggtcaggagatcgagactatcctggctaacacggtgaaaccccgtctctactaaaaatactaaaaaattagccgggtgttgtggcgggtgcccgtagtcccagctacaggctggggcaggagaatggcgtgaaccccggaggcagagtttgcagtgagccgagatcgcgacactgcactccagcctaggccatagagcgagactctgtctcaaaaaaaaaaaagaaaacaaaatgtctaaaatgggagaaagggaattcaaaataacaaaagtatatgtgtgtgttactcagaagcatgaagtatagatgtaaagggcagaaaaaaaaactaacagctgtcaaaggtgcctgcctgtagtcctaagtactcaggcaacagaggtaggaggatcatttatgcccaaaaatttgatggcagcctggacaacacagcaagaccctattctaaaaaacaaataaataaaaataagagctgtcaagtagagtttgagaagtaggaatcagctgcagaataagaaaccaacttgacagaacatagaaaaactaaacagaagccatctggaaaaagaaaaactagagaaagaattatatatttttttatttttttattttttggagacagagtctcgctctgtcacacaggctggagtgcagtggcgcaatctctgctcaccacaacctctgcctccagggttcaagcaattctcctgtctcagcctaccgagtaggtgggactacaggcgctgccaccacgcccggctcatttttgtatttttaatagagacggattttcaccatgttggtcaggctggtctctctgcctcccaaagtgctcggattacagacgaagaatatttttaagaagggcaaaagcacatgtgagggagtagaaaaatggcaaaacaagagaagattaacaaatgaaagcacaatggaagactagaaagatatgatatacagacgcatcatcacactccaaaactcagacattctagaaagcatgggcagttcacagatggccagcctctgccaaactgggggagaatactaacctctttatattcttcacagccactgcctcttctccctccattccttaccttctatccaaagcaccctgttttgtcatttcactcaaacctaactttacagaatagcttcacatgttccaaagttactcactagttaatccatattccgttgaaatccccaggttctaatgtaaatgactttaaatttgggggaaaaaaaaagactctaagtgtaagagaggtgaggccgaggccgaggccgccgccgccgcccggccaggccgaggccgccgccgccgccgccgccgccgcccggccaggccgaggccgaggccgaggccgccgccgccgccgcccggccaggccgaggccgccgccgccgccgcccggccaggccgaggccgaggccgccgccgccgccgccgccgccgcacattaaccttttaagttaaagattaagagaaccaacacctctttacagtgaaatgccccaactaaatactaccgtatggcccaccataattgcccccatacttcttacactattcctcatcactcagctaaaaatattaaatacaaattaccatctacccccctcaccaaagcccataaaaataaaaaactatagtaaaccctgagaaccaaagtgaacgaaaatctgttcgcttcattcattgcccccacaatcctaggtctgcccgccgcagtactgatcattctatttccccctctattgatccccacctccaaatacctcatcaacaaccgactaattaccacccaacaatgactaatccaactaacctcaaaacaaatgatagccatacacaacactaaagggcgaacctgatctcttatactagtatccttaatcatttttattgccacaactaatcttctcgggctcctacgccgaggccgccgccgccgccgccgccgcccggccaggccgaggccgaggccgccgccgccgccgccgccgccgcccggccaggccgaggccgaggccgaggccgccgtcgccgccgccgccgcccggccgaggccgaggccgaggccgccgcccggccgaggccgaggccgaggccgccgcccggccaggtcgaggccgccgcccggccaggtcgaggccgccgcccggccaggtcgaggccgccgcccggccaggtcgaggccgtcggtctcttcgagatccactcacctttccaggcgacggggcggagccctgcaccgaggcgaggtaccgctccccgtaggctttgctgcgcctcatcgcaccgccaacctggctcccgagacgcgtgaaaccagcgctcagccccgcagcagtcgccaattccaacaggaaagcgcctgaaagccactgacgtagccggcggaggaccactgtgacgcacttgtgtactgcgtcagcactgtgtatccttggcgacgtcggcgctcgagctgcactcggccgggctcttggcagcaccctgtgctctgagggtgtcttgcccgccgggcgccgtggctcacgcctgtaatcccaacactttgggaggccgaggcgggtgctgtaaaccattcatttgcttatttcaatattttcatttgtatgctttcagataagctgaacttgttccaatctgctatacataggtttgtttatatctttacagtaaatatctcagttaagaattattttctctttgtaaagacattgtgactcagatactacttgtaaagtctataggaacacacagctagtaaatggcataattgaaattcaaatggaaatctgattctaaaatatacttgtagcaacatagctgattcctgttactgtatctgctcctgtaaattttgtaaattcattacaatttttaaaatataaaatattttcatatatttatttagtctttgctaccatgaatagcttcaatgggaatgatgattaattctagaatgtgcttgtcttttacatttctatgatttttagggttaaaataaaccttgttggtttacaaatgattcctgaatgatttctttcctctaaatgctacagcacttcactacaaggtctgcaaagaagctatgtgggggagtgaagtaggaggtgactgagattatgtaattaagttcatatatgtcataatttttcattgttcccactgttttagagaaaagtaacaaaggagaagacatgtgggcgtgtagagaaatgcaaggtggagatattaatgctacagtataatcttctgtgggtgtttagcctggggatgagaaaactaaggagaaccatgccagttgtgttgaaatatttgaagagctgtcatgcagaagagagaatagacttttttctgtaggcccagagggtataactaacattaagggaagaaagtcatagggtagaaaaattttattcaatttaaggaataactttctaatagtgcatagtattggaacaggtggctgcataaagtcccacgaagtgttcattctaatgctgaatacccatgcaccaagaatcctgtggaaatgatgcttgcagggattaaagaatgaagtagaatctaatctaatatagcctcttcctactagaatgccaaactcagaaagactttctctctgttctctctttctctctctctcgtgctctctttgtctaatttatctgtatacctatttaatttccaaaaaatgagattgacaggaagtgtaagagttaaaaagaataatgtgtgtatgcgtgtgcatgtgtgtgtgaaaaaatggattttaaaggtattggatgcccgttgagaatgtttatattcctctaccccttgaggtttatggttagcaaaaaaatagtaacaaagataattttgttatatcttattgtatggcagaaggagatttccatagtagaataaaaaaaacttttaaatcagagataacctgggttcaaattccaactttctcactttcagctttttgaccttgaaaaagtaactgaacctttataaaccttcatttttttactataaaatttggataataaagtaccttaactgtagggttactgagaaattaaatgagacaagtcacatgaagcacactttatattgcctagtatgtagacagcaataataaatcctggcttcatatatttccttactttagtttacattgtttttacaaacgtatcacatcagctgatagaattttgatgtcgtcatttaagtttctggttatctggtgtagaatgcaactgtttttctgatttaagataattcaatcaacaaatttttcttgagctccaattttgctcattctacctttctctccatgcaaaaagaaagtgagaaatgtcatttcatttggcaatggttaaacataggcaaacctttagaaatatttctttattttaaaatttgtgcttgtaaaatacttagttataatatatgtttactaatttactgttttttaaagttgttttattacggaaaaacaattttggtgctatacaccccagagaatactttaatgctcaattatctgaaaaaataatctatggtatgctttttcacagccctgctgaattctaggtactcttcctcgaatttgtgtgagaaaatatgtagactcacagtttacttcagaattaaaaatattactacagaatacattcaaattttatacctctgattgcagcatattgaaatgcttaagaagttccattagtgcagatgatgacaactatgtatgcaaaagtaccagagaaattttatgtgtgtttttatgcatgtatctttgtgtatggttacagtatgatcgtggcaaatgtataagatacacacatgttacacttttcatgcctgattaattcataaaaggcatgtgtgtgagtgtatgtatgtgtgtatttgcttatgctcactttctgtgcttgtctaaataatgaagatttttttcctgtatctatgctttcagaaaccatacctgactaactggtggggaatgtgtatttacattttgccactacactaattatttctgattaaattttctagttgcttacgtaaatcatgaattggattctcgtgttaatttgactaaaactaccaactagtaaatattttcaattaagtgattttcttcataattcccatcaatgattctttgttcttgttttttaaagaatattttgattaaaatacaatagtgtcattgtaaaatgattgacaagtataatgaatgaaataaaaatagttgaagatttttaaaccaaaacaaattcagtgataaatgttaatatattttattctagttgtttgtatgtctgtatgtagcagataaaagaaaatctccatgggaattgagatgcaaatgagattgagacatcattaggataaaaatgttagaatcatgaatgtcagaaaaaaaattagtacctggtaaacttgaggaaatctttgtactttccaaagataaaaagaaagttgttgcaaatcaatttatttttattccgaaaagacaaagtgatccagctgatatacagttatagataaatgcatgtacagtcatacagtgtatatcctgatgctttatataatatgtgacagcaagcttgtctttcttctttaataattgttgaaaatttaatttttgtgaccacatggtaattgattacaagaagggactatagtgtgtttatttattcatttcttgaacatttccattgctttctactttaaaattgctttaacagtgctgcagtgaagatacatgtactcaaatattttttaataattctactaattttcattaattatattcctggaaatgcatgtagaaaattaaatgatatagatattttaaatattcttattaccatattacttgattatttttgccacattactttctagaacagttgtgtcaatctgttttcttgttgggaaggtaaaatgcaaacattagatgtctagaacccaataaaaaagacaatgtaaacaagttgtattagtttgttctcacaccattatgaagaaatacctgagacacagtaatttaaaaaaacaaaaaaacagaagtttaatggactcacagttccacatggctggggaggcctcaaaatcacagtggaagggaaaagaggagcaaaggcaagtcttagaaggcagcaggcaagagagtatgtgcagaggaacggccctttataaaaccttcaggtctcatgagacttattcactattgtaagaacagcaagagaaaaaaaacccgctcccatgattcagttgagtcctgtcaggtccatcccatggcatgtagggattatgggaactaaaattcaagatgatatttggttgaggacacagccaaatcatatcattctgcccctcaccccttcctttcaaatctcattttctcacatttcaaaacacaatcatgccttcccaacagtcccccaaaatcttaactgctttcagcattaactcagaagtccacagtccaatgtgtcatctgagaaaaggcaagtctcttcggcctgcaagcctgtaaaatcgaaagcaagctggttacttcctagatacacgggggtgaaggcattgggtaaatacacccaaatgggaaaaaatggcaaaacgaacaggctacaggccacataaaagtccaaaattcagtgaggctgttaaatattaaagctccaaaatgacctcctttgactgaaggtcccacatccaggtcacactgatgcaagaggtaggctcccacagccttgggcagctctgcccctgagactttgcagggtacaggctctctcctgggtactttcacagcattttccacccctgctgaaaacttctgcctggacatccaggcatttccatacatcctctgaaatctatctagagattcccagcaagatcaccatctacatctgagaccacctcagcctggattttattgttcatttcactatcagcattttggtcaaagccatccaacaagtctctaggaagctctaaactttctcacatttttctgtcttcttctgaaccctccaaactctttcaacctctgcctgttacccagttccaaagttgcttccacatttttcagtatcttaatagcagtaccccactctactgataccaattgactgtattagctcattctcatactgctatgaagaaataacaagactgggtaatttataaagaaaaaggtttaaaggactcacagattcacatggctggggaggcctcacaatcatgtcagaaggcaaaggaggaagaaaggcatgttttacatggtggaaagcaagagagcatgtgcaggggaactgccctttataaaaccatcatatctcatgaaacagtcactatcacgagaacagcactggaaaaacccacccccatgattcaattacttcctgcttggtgtctcccatgataaatggggattatgggagttacagttgaagatgagaattggagtgggacaccgtcaaaccatatcacaaatagtagaaaaagacctacagcacattaacatagttgcgttaccacacaggctttaaaattaaagttatttttgcatgaaataaaacacgagaaatatgtttttgcatgaaacaatgaaaatagtcaataaaataatggaaagtatggtaacttaaataattggattcatgagaaataaccaaataaatattctagagattaaaaatgcagtgtctcaaacttaggccatataaaatatgtttaacagcaaacaggacatggcagaagacaaattagtaaaatggaaaagatatcaatggaaaatagtcaatatgaagcacagggcaataatgatttttttttactggacacagtgtaaggaaaatgtgagcacattaaaatatctaacatatatgttgttagaggtacagaaagagaagagagagaaaatagagcagatgtaatatttgaatatgtaataccaaaaattgatagacttcaattgacaaattcaagaatatgagtgaaccccaaccaaaataaaaacaaagagaaccccatgtatatgcttagtcaaattactgtaagctgaagtcaaagtgaaaaaacatatcttaaaaaaatagctgtgatttgggaagagacatacaatgttactttcaaatcagccacagtaatactaacaactagattattttccataagaaatggagccagaagacaatagaaagttattattaaaatactaagtaaaacaaaatcctaataaagagaaagacctaccaacctatgatagtatccctaataaaaatatcactcaaactgaaagctaaataaatcattttcaaacaaaagattgatgagataattcatcagcagaactgctaagtgaatttctcaagctgaaatcaatgatgataccacatgagaagcagaatcacagtaaaaaaaaaatgaagagtattagaagctttaatatataaataattataaaataatattttaataatattgttaacacagaaacaacaaaatcttggtagatttataataaatatgtatataaatatatgacaaatatcacaaaaggcatggaaatggtgcgaatagttatatatgctttgtaaaatttgtgcagttttataaaaatattagtactactaaaaaatggttgattataataactaggaatgcattctgtaacctaaagatgttaataaaaattaataaaagaatgtacaagtaaaacttaatataatagaactaattgtataagaatgatgattaattgaaaataaataaatttaccaaaaacaaagaagaaataatgaaacaagttgcaaaatggttgacttgaacctacctatgttagtaattgttttaaatgtacatgtactaaacactctaattgaaaagcaaactgtcggaacaattagaaaatacaactagatgctgtttaaaaaggacaaatattaactacaacaacacagaaagtctggaagagaaaggacagaaaagatataccacacaatctctaaataaagttactgtaggtaaatataaactatatcaaaatatcagaccatgttgaaagtaacaacttttattctttggaccataaacccacacacagaagaagattattaaaatatgcatttaacaaaagattttatttagaatagataaagaaatcctggaagtcattaaaaacaagataggcaattaaatttaaaactaaatggtaggctggatacagtggctcagtcttgtaaacccagcactttgggaggctgcggtgagagaattgcttgagtctagaagtttgagaccatcctgggcaacatagcgagaacctttctttaaaaaaaaaataaaaattagccaggcttggtggtgtgtactccagaggctgaagtgggaggattactttatcccaggaattcaagactgcagtaaactacgatcatgccactgtactctagactgggtgacagagagtctagtctctgtctataaataaataaataaataaatataacatagtaaaagaacctgaacaagactttcagaaaatgatatgtacatgaccaataagcacataggataatgatcaacgcaactagtcattaatcgaatgaaaatagaatcacaatgagacactactacagacctactgatgactaaaattaaaaagacaaataataccaaatgttgacaaggatgtaaaggaactgacaatcccatattttgccagtggaaatataaattgctgtcagtttttcagaaataattttggctgtttctactatatctaagaatacatacatctggtgagccagcaatttcactccaagagaaatgagttcttaccttcaccatgacatgagcaagaatattcataacagttttatacattatagccataaacataaactgccagttaaacgaggagtttgaggagattttggttgaaaagtacaaagatttagttagaatgatgaataagttccagagcactattgtacagcatggtgactgtagttaatagttaacataatgtatactttaaaattgtttatagagtagatcttacctgccttcaacaccaaaaaataataagtacgtatggtgatggatatgtttattagcttgatcccgtcattcctcactttatacatatataaaaatatcatatatgcttcaaatatatatatagttttttgttaattatagcatagtgaagctgaaacaagataaaataaaatgtgggggagttttaccatatggagaagctggtaatagcacaataacaataataataacagtaataattgttatataacccaaatatttcaaagaatgaatgatagttaaaagctacatatcttatattacaattttagttatactatttatctaaagaagccaaagcttaaatataattaattgatattttaaaaagtaaatacttttatcgggaaatgcagaaaagagagcactttccagctttcagtagaaagccagcattgtcctgacatcaaaatctgatacgtaaattataatagaaaactacagaaaaatgtctgtcatgaatatagatgcaaaaaaatttataaaacattaggatacaaaatccatcaatttataaaatgtatactacatcataaccaagtggattttttacctggaatttaatattggtttaatatttgaaaatcaatcagcgtgattcaccatgaacagagaagcggagaaaaatcagaaaattagaagtgcatttcctttatctgataaataacatctaagaaaaccttcaatttatatcatatttattggtgaaaaactgagctctaaaccggggaagaagaaaaaggtatctgtgcacaccatttgaagtcaaaattgtaatgaaagccataacaagtaagacaaggttgaaaaaatatgcaaggcctcagcctgagaagcaagaattaaagctctccttatatgaagattacatgatcatagatgtagaatatagtaaaaaatgcacagaaaatctactagtgctagcaaatgacttttgcacatattcaggatacagtgtgaatatatagaaaaaatagattttttgcttactagtaacaaacaattggaaagatttaaaatatcactcaaactaacacaatatgaaacaattggatatgaatttaacaaaatacatgcaaaaattatacactgtaacacataaacattgctgagaaaaagttaaaaagccataaatgagtggggaaagatattgtattcatgaatttgaagttccaatattgttaagatgcccatattcataaaatgttacatagatttattgtaatctcacacgaacatgaggatttttaaaaaaatggttaagtggatttgaaacttataagaagcaaaagacctataatgcagaaaaacaattttgaaaaagaagcccaacgttgtaatactaacattagcaaattgaagactcaatatataactgctgtatatgatcaattgattttctgactaaggtgctaaggtaactaagtatggaattaataatatgtcaacaaatagttctgagaaaaacaggacatctgtagataaaaaaatacatatttacatttatctcactccatatacaaaaatgaactggaaatgcatcatagatctaaatataacaaccaaaattaaaagcttttagaaaaaattgtaggaagatgttgctgactttgaggtaggcaaagggttcttagacatataagaacaaattctagtcatagaagaaaaatgatctgatacagctgaaaacgtcactataagaattttataatacaatcagaaatatcaacaagagaaaggaataagcagaggaaagaatctcagtgttcaaaaaaatccgttctttgaatcaactcagtcagacaattataaagaaaaaagaataaaaagaatgattaaaacctctgaaaaatatgggattacgtagacaccaaacctatgactcattggtcattgtgttgtgggaattgagggactagagagaccaatgtgtggaacaggagaattttatttaggtgaccactggctcagtgaactaacatccacaggctgagccctgaacaaagacagggctccacttttatacatgcatctgaaaagggtgtgaaatctgtaaggcgggtaagcaagcttacagaagcagaacaaaggcagtttatcaaccagtgacaggttttacaactcaagccaggtgttgcaactcaggcatatcttgtgaccttcgttgtgctgcacagaagggaaaaacaggaacttacaaaacttgcaaagataattgtgagaatagtaagggggaaagtggaagctgaaagagaaaaacttgtttttcccaaccttgctctgggtttggagggagagactctggagcccattccttcttagccttggctctgcagatagtgctatcaaagcctccacagagccctgcccttccctgggtcttggagtgagtgagcctagtacagaaaaacttgtttttctttttatatcttctgcttcaattggtgtccttgaaagaaagtgagagagagcaaacaacttggaaaacatatttaaggatattgtacacaagattttcatcaacattactatagaggtcaacattcatatccaggaaactcagataacccctgtgagataccatacaggatgaccattcccaagacacatagtccttgatcctccaaggtcaaagaaaaagaaaaaatattagtgggaactagagagaagagacagacaaatagagaaagaaagaaggaaggaaggaagaaagaagaaagaaaggaaagaaagaaagagaaagaaaaagagagagagggaggacggaaggaaggaaggaaggaaaaaaaagaaaagaaaagaaaggaaaacagaaacaaaatatcaggccaacaatggaccattcagcagaaaccctacaagccagaagagactggggacctatattcagcattgttaaagaaaagaaatttcaaccaagaatttaatatctagccaaactacacttcataagtgaaggaaacattaaatatttattagaccaagaaaatgctgagagaatttgttaccaccagagctgccatataagagttccttaagggagtactaaatttggaaacaaaaggccctaaccagctattgcaagaatcattgacaatgtaaatgaacaacacaatcaagtcatcataacaactagcttacaacacaataacagaattaaatccacaggtatcaatattaacatccaatgaaaatggctacatgctccacctaaaaagcacagagtgacaaattgggtaaagcagccaaacataactgtatactgccttcaaaatagccatctgacatgcaatgacacccataagctcaaagtaaagaggtagataataacttatcatcaaacagaaagaaaaatgagcaagggctgctattcttatttcagacaaaacagactttaaaccaacaatcatcaaaaaggacagagaagagcgttacataatgataaaagtttcaattcaaaaatatgtgactattctatctatatatggacccaatacaggagcccccagattcatcaaacaagttcttagagacacacaaatagacagataaccacacggtaaaactgggagacttcaacattccagtaaaggaattagacaaatcatcaaagcagaaaactaacaaagacattcaggacccaaatttgatacttaactaaatagacctaacctctaccaaaccttccacccaacaacaacagaatatacattattctcatctgcacatggcacataccctgaaattgaccacacagtcataaagcaattctcgacaaattcataaaaactgatatcacaccaaccacactctcagaccacagtgcaatataaatagaaatcaatatcaataagatttctgaaaattataaaattacattaaaattaaacaacctgctgctgaattactttgggtaaagaataaaattaaggcagaaatcaagaaattctttgaaactagtgaaaacaaagatacaacgtaccggaatctctggggtgtagcaaaaatagtgttaagaggacagattatgacactaaatgtctacatcaaaaagttagaaagatctaaaattaacaacctaacatgacacctagaagaactagaaaaataagaggcaaccaacacccaatctgccagaagaaaagaaataaccaaaatcagagttgatctgaaggaaattaagaagggaaaaataatgcaaaagatgcaaaaaaccaaaacttggtttcttgaaagaataaataagtttgatacacttctagttagaataatgggaaaaataagaagatttaaatagaaacattcaaaaatgagaagaacacattactactgactatacagaaatacaaaaaaccctcagggacaattacaatcacatctatgcacacaaattagaaaacctagaagaattaaataaattcctggaaacacaaaacctcccaagatttaaccaaatgtaaattaaaaccataaacacacctctaaggagttctaaaattgaatcactaataaaaagctgatcaaccagaagaagcacaagaccagttgaattcacagtcaagtagtactaccagacatataaagaagagctggtattaattctactgaaactgttccaaaaagttgaagaggaggcactcctccctatctcatcccataaagcccacatcattctgatacccacaccagtcaaacacactgcaaaaaaggaaactttaggtcaactttcccaataaacttagatgtaaaattcttcaacacaatacaaacaaagttaatccagcaacacatcaaaaagctaatccaccatgatcaagtaggcatcattcctgggatgcaaagttgggtcaatatatgcaaatcaataaatgtgatgcatcacataaacagaactaaaaccaaaaaccacgtgattatagatgtagaaaagactttcaataaaactgaacttcctttgtgttaaaaacccttgacaaactaggcatcaaaggaagatagcacaaaatactaacagccatctatgacaaacccattgccaacataatactgtacaggtaaaagctagaagcattccctttgagaaccagaattaaacaaggatacccacttttacaactcctattgaacaaagtattggacatcttaggcccattctatttccgcagaagaataatgagatgttcaacaaagctgacgataagaagcaatgggaaaaggattctctattcactaaatggtgctgtgataactggctaaccatatgcagaggattgatactgaattacttcatttccccatatcccaaaatcaactcaagatggattatagacttaaatgtaaaacccaaaactataaaaaccctagaagaaaacctatgaaataccattctggacataggtcctggcaaaggtttcataaaaaaaaatccaaaagctactgcaacaaaaataaaaattgacaagtgaacctaatgaaactaaagagcttctgcacagtaaaagaaaccgtcaacagaaaaaacagacaatctacagaatgacggaaaatatttgcaaactatgcatccaacaaaggtctaatgttcagaatctataagacacttgaacaaattaacaggcaaaaaacaaacaaccccatttaaaaaatgggcaaaggccatgaacagacacttctcaaaagaagacatatatgtggctaacaagcatatgaaaaatgctcaatatcactaatcataagagaaatgcaaatcaaaaccacaatgagataccatctaataacagtcagaatggctattatcaaaaagtcaaaaaataacagattctggtgatgttatagagaaaaccatttgacccagcaatcctattcctgggtatatacccaatggaatataaatagttctaacgtaaagacacatgcactcatatgttcttcacagcactattcacaatgggaaatcaacatagatgcccatcagtggaggactggataaagagaatatggtacatgtacaccatgggatactatgcagccataataaagaagaaaattgtgtcttttgcagcaacatggatggagctggaggccattatcctaaatgaattaatgcagaaaaagaaaccaaataccacatattctcacttataggtagaagttacacaatgagtacacgggaacacaaaacatggaacagtaaataccacagcctacttgaaggtggagggtatgaggagggtgaggattgaaaatccacctactgggtactaggattattatccagatgataaaatgatctatacaccaaaccttcacaggtactcccaaacctaaaataaatgttggaaagaaaaaaaaaacacattattcctcaagagtgtttacacaaatagcacacttactgtaaaagccagaaaatggaaataactgaccaatgaagaaataaattgtggttcatccatatggtgtgtactgaatttaagagtatccccttcaaagttatgtccacccagaaggtgtgaataggatcttatttggatataggatctctgcgtatgtagtcaagttaagatgtggtcatgaaggattagggtaaattctaatccagtgactggtgtccctataagaagagggaaacttcgacaccaatatactcagaggaaaatggctatgtaaagacagaggctgagattagatttatgctgccacaacctgaagaagagcaaggattgatggtaactcccagaggctagaagaggcaagaaagaatattttgatagagcttttggaggcaatatggacttgccatactcattgattttgaacttttattctccaagaactttgagatgataaaattctgttatttttagctgcacagtttgtggtaatttgttatggcagccttagaaagtagtacatagaggatgttacccagaaaaaacataaatgaacccttgatatacaaaacatggatgtattttaaaaaaaaaatttaaaaagaagttgaaatgaaaaatgcatgtagtatgatgtcctttatatacagttttagaaaggtaaaactgttaataagataaaggagaccagtattttcctttgttcagatgtgtgaggaattcactgcaaagagcatgaggtagttttatgagaaaaaaagaaatactcaatatctttttctatatagttattgatgtatatacatttgtcaatataaatcaaattgtacacttaaaatgactgcattttatgctatacaaatcatagctcagtaaagtttattttaaacagaaaagaaatatatgcattgtagaaaacttaaaaatatatttaaaatgatgtttatataattgtattagaaggaaatcactgttaaattttgacacaatcatgttctatcctaactttctcacttgtcacatcaatttcccaaatcaacaagacactttaataggactataactttctaatctgtatgacagttgatatagtttgggtgtcttctctaaatctcatgttgagatgtaatcctcagtattggtgttggggcctggtgagaggtgtgtggatcatgggagcacatccctcatgaatggcctaccaacatttccttggtgatgagtgagtttacacaagatctagttgtttaaaagtatgtggtacatccccccttctctcttgctcctgctctggccttgtgacatccctcctcccgcttcacctttcaccatgagtgaaagctcccttgaggccgactctgaagctgagcagttgctattaatagcaccatgcttgtacaacctgcagaaccctgagtcaattaaacctgttttccttataaattacccagtttcagatattcctttatagcaatgtgagaaaaacctaacaccacagtctcatattacaattatataatttctttaaattttaaatataggtttggtaagctattgattattgccacaatttcagagcctgttattggtctattcagagagtcaacttcttgctggtttagtcttgggagggtgtatccatgaccagatggattcacagtcgaattctaccagaggtacaagaaggaactggtaccattccttctgaaactattccaatcaatagaaaaagagggaatcctccctaactcattttatgaggccagcatcatcctgataccaaagccgggcagagacacaacaaaaaaagagaatttagaccaatatccttgatgaatattgatgcaaaaatcctcaataaaatactggcaaactgaatccagcagcacatcaaaaagcttatccaccatgatcaagtaggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccaatatcatactgaatgggccaaaactggaagcattccctttgaaaactggcacaagacagggatgccctctctcaccactcttattcaacatagtgttggaagttgtggccagggcaattaggcaggagaaggaaataaagggtattcaattaggaaaataggaagtcaaattgtccctgtttgcagatgacatgactgtatatctagaaaaccacatcgtctcagcccaaaatctccgtaagctgataagcaacttcagcaaagtctcaggatacaaaatcaatgtataaaaatcgcaagcattcttatacaccaataacagataaacagagagccaaatcatgagtgaactcccattcacaattgcttcaaaggcaataaaatacctaggaatctaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatgtatagattcaatgccatccccatcaagctaccaatgactttcttcacagaattggaaaaaactactttaaagttcatatggaaccaaaaaagagcccgcatcgccaagttaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctcatcttggacaaacctgagaaaaacaagcaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacagtgaactcaaacaaatttacaagaaaaaaacaaacaaccccatcaaaaagtgagcgaaggacatgaacagacacttctcaaaagaagacatttatgcagccaaaaaacacatgaaaaaatgctcaccatcactagccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaacccttgtggaagtcagtgtggcaattcctcaggaatctagaactagaaataccatttaacccagccatcccattactgggtatatacccaaaggactataaaacatgctgctataaagacacatgcagacgtatgtttattgtggcactattcacaatagcaaagacttggaaccaacccaaatgtccaacaatgatagactggattaagaaaaggtggaacatatacaccatggaatactatgcagccataaaaaatgatgagttcatgtcctttgtagggacatggatgaaattggaaatcatcattctcagtaaactgttgcaagaacaaaaaaccaaacaccgcatattctcactcataggtgggaattgaacaatgagaacacatggacacaggaaggggaacatcacactctggggactgttgtggggtgtggggagggcggagcgatagctttaggagatatacctaatgctaaatgacgagttaatgggtgcagcacaccagcatggcacatggatacatatgtaactaacctgcacattgtgcacatgtaccctaaaacttaaagtataataataataaaataaaaaaataaaattttaaatataggtttttaatagtttttgctttaaattattcaattcaattttacttattctgatacacggtttcagaataaaaataattattaatagtgttttgcagttatgatatttttaattttataattatttaaaagtaccttttcttatctatttacacatattcttgattgtttagatattataatgtagtcaaggactcggtacatctaggctgatagcaaaacattcactcttgttctgatttgcctattatatatttcagtgatgattcatgaaggttttcttgtttttactttttaaaataatttcacgtaattttaggtgacagaataatttttatgtttcgaaattaataaaggtgaattaatgtcatgtggagatacattatatatatatattcaagtgaattcgtccagaaagatggaattttaaatttccatttcttaagtctctcagtaatttctaaaatttcttaagatattatctatgttatttgtattaattttttattttattttacaatttcattgtttcttcaaatatatatttctattatattttctaacctgtaatatctcatttataaggaaattattgattttgtatatttagtttataatcatccagtttacttctattacttgcagtattttgtagttgcctcttttgcattttctatttttctaatcatagcaccttaaaataacgattattttgtcatcaattttcaaataggtaaattactgattcttttcttattgtctgagcaatacactcagactagtattaaataatcctgatgacagtgcatattatttcttgtcttttattccaatgaaaataatgttggctcttaggttatggtaaacttgcactgtggctaagagtatgtcctatggagaaattctgcatttcctagttgaactttcagtgactcaaactcctgagcctttttcttcatttgaaataaagaagctgatagtgccttatcttatagagttattgtaaggattaaatgaggtaacaaatgtaaaatgtttactacggtggccaacatattctaagggctcaatgttagtaacatcaggtatgaatgctaaattaaatgtctttctgtggacatttcttctgtggagctatttttttctcattctatttatgttatagataaaatatgatttagtatagtaacatattcataaaagaaaatataaagctattttttcattgatgaaacaataatttcctcaccacagaatagcatcattttatacacaaatgagtttgatttgctagggggggtttgttgaaaatatattttaaattagcatgtgcatgatcaggctgtacaactttgtgttattatctataaggtcatggtattagttttaaactagcttagcaaaatataaatcttagttatttttataagtgacagaagagtttatacagcatattaattatccgatcttgaaattttaaataaattctctgtaaaaccaaatgaaactagtgctatatttttagtaatgctttattaccttttttaatattttccattgtcattgtttctttcaagacttttgctttaagataattttattttgcatagaaacttatactttaaattagaaattatacttattagcatattttattgacagtattatcttataattttaaaatatctttattgtgattttattttcttaatgattaaaatttgatttatgttcgagttctcttcttgattacaatttcaaaatacttttcttatcattcattttttcttatacattttataaacagtacattatattgtgcatagtgttttgtatactgcttttgatcaattaagttctttaaacaccattaattttacttgtatatcataattttcctatatgtggtgtttttttggggtaatagcctcattggtatataattcacataccatacaattcacttatttaaggagtacaattcaatggcttttaggatgtatacgaaggtaagaaaccattaatacaaccaatttcaggagattttcattactcttaaataaacatccacactcattatttcaatgcttgcataccattgaattatgcaggcacagtgtggttactaaaatattctcaattattgaacaattagattatttatacattatgatattgttcccaatacatagacatgataaatattggatgtgatgtgaaccccaaatacattgacttgatcattacacattctatgttggtaaaaaatatcacatgcatcctataaatatgtataaatatttctcaacaattttttgaattaaatattctgatgaacattcctgcagccaaactttgtgtaagaacgctatgagcatacgtgcaaaaactaccagatatataccaaaagccttaaacatctggtaacttttcatggagaaataccttccttctagatcattcaaccatggctattagcattttttaaatggtaaacattagaaaagtcatgttatatttgtatattattttgccttccttcaggtgataccaagtggaatattttttatattttgattagctgttgtggtttattttctgcctcagaagtatattaaaagttttttgtttttgtccttttcagtttttgaaaataaccatgtcttttgtaactgttttgtatcttatttcagttgctgctctgtcttctttttttaattaaggcaatattagccttatttttccgtgtttttaatgacaatgcagttgtgtttttacttttttagaaatgatattcctagtttcttaggaacttgtttttcatcaacagtggtaattcatcaaattggtaatgaaatttatcaactgaatttttagtatctttccagattaccattgattttacttgatgatatatgttattacatttattgatgttaagccactttgcatgttaagcgtaaaacctttttctaaccaacttatatttggatgacataccattgtgttttattttctagaattctcatatctatattcaaatctcattgcagtttttgtgttatatttctgttttttaatatacaggtatttcttgcttggcaaagtgattagcatgttttgatattttttctattgtaggagagtttggtttagaattcataatttcttgaaagtatggagatatttcagtgtaaagttgtctggcttttcagattattttgagctaagtatttgacataattgttttttaattttttttttttttttttgagacgaagtctcactctgtcaccaggctggagtgcagtggcgcaatctcgactcactgtaacctccgcgtccagggttcaagtgattctcctgcctcagcctcccgagtagctgggaccacaggtgcatgccatcacgcccagctaatttttgtatttttagtagagacaggatttcaccctgttggccaggatggtctcgatctcttgatcttgtgatccgactgcctcaacctcccaaaatgctgagattacaggtgtgagccaccgcgcccggtcctatctgagataattttgattttaattttaattcttttgaacttctattttagataggagggtatatgtacacgctcattacatggttgcattgcacccagatagtgagcatggtatccaacaggtagtttttcgacccatgacgtcttcctcttccctctaaaagtccacagtgtctattgttcccatgtcataatttttatttttttcataagtataggttgattcacagtttagaagttttctattttttgttttgacatcctgtggtttcctagaaaataagtcatattttctagatttccaaattcattagcaaggagtaatacatattttctcatacaatcaatagttattaatacagcttcttgctattcctgatttatttgtattttattatacattatccattaagcatgacagaggttgctgtagtttgtcttttgaaccaatttatagctttaaaaataaattaaaatatattactattgtacaaattgttaattcatagtttcattatttttatttacttaaaagtacagattattttcattatttctcagtaaaaaatgtagtgatgctacatgatgaatttaattttggcagtttcggctgtagtccatgttttagtgaaaatctttgttttataatcctcttgatatatatttagaatcagtttggaatgaacatatgactgattgagaaatgaattctggaggaatgaaaccaaagaatacacgttattcagtatcatatatattttcatttgtggttaattggtacgattccaataacttcagagctagagaatgtaaaaataatattgcagtgttacacaatcaaattgagatggcatgaggattaaaatctttatgataaaaacacaaacacagaaacaactctggcttcatttttatgtcatgtgtcttaacctggggtttaataacctaaaaaataaatctggataccacatcaaagggctttcaacgagctctacaaaatgacatcctggccaaaattagaggttttggtttaaaaagggtggaaaataattgagggtgtggtgtgtgtgtgtgtgtgtgtgtgtgtgcaaatagataaatataagccctttcttttattttggtatcaatgctagtcctaggatactttctcagagacctatgacaaagtaactttggaagtttaatcatttcttacaaattattttttcagaaaattgacgtttgagttacaaaaaaacattaaacattgctctagtaacagcatgtatattgtcttcacaaaatatttaatgccaaaacgataatttatggagagaaaaattgtattttcttccaagcatgtgtagtgagtgtttcaaaggtaatcatgaagcataagataaactaagaaaaatgcatatactgataatgtatttatataggaaataaataatgataatacaaatttacaaagctgagaaaattaagggaatgaattgtgtctgtttttatttgaaaagactattatagttagttgagatgtaagggttgaaatatgattgctatgattcttatacttatcagaataattttacagatgacatagcatacaattactagtataattactactcactccaggaaataattgaagtcatttattaattttgagattttttttccttttttccaaaacattatcataagagtttttccatctttatatggacaagtgtattcagatttttctcgtttttcagataggaataatatgtgctaggcacacaactgataacaacaacaaaaaaataaaaacatgacaacaggactagagtatatctacccatgtgtacaaatgtgcctgtgatatgaagggtgaagtatttgccaaccaaatggtaacttgccttctaaactagattcctttcaaatccaatacttcccctttatactgacatgttggttacctacattcagaggaatattgtatatagtcatacaactagtattagtcagtcagcatgctaattataatacaatcatctatgtggtgaaaactgctgatgtaacatattcagctctgtccacgtggggctttcatgcttttgggtttgatgttccctacatctaaaatgtcctggaatcgacaaactagccttagaataatttctcatctttcaaatctgactttacgtgccgtttcacctgtgaagaatttaaattttttggccaatcttaatttgccaaagaaaattgactatgctctctccttagtcttcaactgtgccctggcatggctaaaacttaattgaacgtacttatttttgtaatgataaatcctttgaagtcaaatgccatgttcacttgtttcgattcaacattcccaacacattatctcaaatattatttattgattgaataaacgattaaatgaataaatgtattaatgaatgaatagaaatcaacaagtcaattaagttaataagctggtcagatttgtcacttacacctcaaccacctcaaagaaattggctattaccttcaaaagatgaaatatgagcttctttggaagttacacgagaaaacagcatacttggttgttttcttaggaatgtgtcacaatcatttcattatgacaccaacaacatcaaattgggctctcaatttgcatttaagggattgacaaaactaggtgtattacaaagcttcgcatgttggctgagttgtaaggactcaaaaacaataaatgggttcctaacatgaatttaccgtaagacccagaaacttctcctctttggttaataaccaaacaaagcaaaatgaggtattcaaactaatccctctacatgaataattatagcagcactgttcacaatagccaaagggggaaaacaacgcaaatgtccatcatcaactgataaatgaaaaaacaaataatgaatttcatacaatatcatgttgtatagcgatgaaaagaaatgaagtactgatacatgctacactatgaatcttcaaaatattgtgctaaaggaaaaaagccagacacaagaggtcccatattgtatgtttttatttatatgaaatttaaagaataggcaaatctgtagagacagacacagaaagcaggttgatggttgtcaggggctgaaagaaatggctgcttactgtgaacagagtctatttagggttgttaaacaattgttagaactagataaaagtggtggtcatacagaattgtgaatatactaaatgccactaaattgtatactttaatacagttaattttatgttatgcgaatttcaccttgattaaaaaaatacagatggccgggcgtggtggctcccgcctgtaatcccagcactttgggagcccgaggcaggtcgttcatgaggtcaggagtttgagaccagcctggccaatatggtgaaaccctgcctctactaaaaatacaaaaattagccaggcttcgtggcacacacctaaaatcccagctacttgggaggctgaggcagaagaatcgcttgaacccgggaggtggaggttgcagtgacctgagactgtgccactgtactccagcctggtccacagagtgagactccatctcaaaaaaacaaaaaacaggccaggcgcggtggctcacgcctgtaatcctagcactttgggaggtcgaagcaggtggatcacctgaggtcgagagtccagaccagcctggccaacatggtgaaaccccatttctactaaaaatataaaaattagctgggcgtggtggcgtgtgcctgtaatcccagctacctgggaggctgaggcaggagaattgctggaacccaggaggtggaggctgcagtgagctgagattgggccactgcactccagcctgggtgacagagtgagactacatctcaaaaaaaaaacaaaacaataacaacaacaacagcaacaaaaaaccatagatgtggctataggggaaaaatcaatgaatatgaggatacaatgaactcatatgggattaattgatgttatttctcttttctttattcactttactaaattcatgtttttgtctaatcttctaagaatcatgagaattgatctaagagtttactgattagaaaattttcccaaaaggaaaaaagatacttatgtctttgttttaggagtagcttctgcttagaaaataaatgtgaatttattacttaggtgtcagagtgtttattttaattaggaaagaacctgtctgtctctgaacactgtacagcttctttttaaaaagccaaaattaattacatatgccactgtcataatacgtaatataacctattgactctagaatttgagttgttagctctgtcttataaataaatataattttattgctcaatgctttttaaagtgtgaaaggggccattgatgtcatattgaaaatgcctataagatgcttttacatctgcaatctacaaagagacattgataatgggaccataaaagaatacttgtgaagctagtccttagtgccactgactttttgcagtagttgtgagcatggttctatgaaggatttgatatatgttgttgcttaagtagaagggtccatgtttcacttggaattaattcagccctttctcttacagaggagcctctgcttctgttctgctctaatgacagcattctcattagaaagcccagaggggttctttaaaaatgtaaatgagatcacattactgggactaccctcaaaaccctccagacttcccatttattggacagaaaagtttaaaattcttacagtggcttgcaaagccttttgcctctgacctcatcttctattgctctgtgttccagagattttggcctctatgctattgattgtgtatactaaacatgctcccatctcaaggttgtcacatttgctgtttctactgcgcagaatgttcttctagatatatttgcataactcagtctcttaatttcttcaagtctctgatggcatgtcaccttattatgggcgttttccctaactattttatttaaaaacagcaaattctccagcacttcctatttgttattgttttattttctccataatagtcatagccatctgacatattacgtattacaaattttttacatttattgtctgattccctcatctagaatatcagctacataaagccagaaatatttttgtctgttttgttcactgctgtattacaagcacccagaaataggcctgcccttagtaggcacttagtaaatactggttgagttaatgacctgctcggtaagtggtgattcattcaatctaaagagtctgatgattcattcctgcctgtctttagttatgagtaatatttttgcccctggtaacttcctctctgtaatttctttttgaaattcctattagtcacatttatccaatatgttgtcacttttttttttgtcttttgactctatttttttaagagacagcatcttactctatcacccaggctgaaatgcagtggtgcattcacagctcaccatggcctggaactctcacgctcaactgttcctcctgcctcagcctcctgagtaactaggactacctgtgtgtgccaccacccctggcaattttttttaaatttttgtagagacaggatcttgcgatgttgtccagaatggtcttgaactcctagcctcaagcggtcctctcaccttggcctcccaaagcactgggattacatgttgaaccaccacacctggccttttaactctattttcaagagatattcttgattatatattttattctttctaatgacttccaacttttaattggtgatgtttaatttctatacattctcatttgttctattacatttgcttttatataaaatcctgtccctttttattgatgaaattggtatcatcccaaatatacttgagtagcctaattatattttgctttcatacttcttccttgaattgtatgtatttctcctagtgtaaaatattcaatttaatccttatgctctttctattttgtacaatttttttcaaatatgggtttatctttgatggttagtcattttgtaaaaatcaaggcctaggctgactatttgtagagcagattgtttccctaataggtgccttccttatctgaaagggaagagttctgtgtaattgagtaagtattgtagcctactcaacttttcttaattgtgcattggaggattggtgaataaccaactcactctgtttcttatcacttcataattaattgaaacagaatcgtgtgtgctgaaaaccttccaatgagcctaactttcccaggctgaacatattattattattgttattattattttgagacagagtctagcactgttgcccagggctggagtgcaatggcgtgatctcagctcactgcaacctctgcctcccgggttcaagcgattctcctgcctcagcctcctgagaagctgggactacaggtgcgtgccaccacgcccagctaatttttgtatttttagtagagacatagtttcactatgttagccaggctggccttgaactcctgacctcgtgattcgcccgcctcagcctcccaaactgctgggattacaggtgtgagccactgggcccggtcatgaacacattatttctttagagaacagtcttttggtagtaagcactgggatgcttctgtataaaccggaatggcaagtggccagtgtggtcagatgcagccattccttttatgttcctttaaatattcaccttctgtgttggtacttccacctgcacatcttccagttctgactgtctggtattccagagctgtgttaggaggattggcttccacctcaactgtcagtagcactttcagactggcttctttcacttaacaatatgcatttaagattgttccatattttttcatggcttgatagcacatccctttttatcactaaagtattctaccgtatgaatgcaccacagtttgtttattcacctattgaaggacatgttggttgtttccaagttttacaaatataaataaagctgttgtaaaaattcctgtgcagttatttcccagctttattgagatattaattgacaaataaaaattgtacgtattcaagttgtatgtgatgatttgatatacatatgcattgtgtcatgatcactacaatcaaattaatcaacacttccataaccacacataggtatgctgtccgtgtgtgtgtgtgtgcgtgtgtgtgtgtataaggaggtgaggaaacctaagatctactctctcttagcaaatttcaagtatacgatatgatattatcaactctagtcaccatgctataaattacatcctcagaacttcttcatcttatacctgaaattgtgtacccttttaccattatctccacatttcccttaggctttcaggtttttgtgtggacaaacgttttccactcatttgtgtaaatatcaagaagtgtgaattattgaattgtatggtagcgctatgtttagttttgtaagtaactgacaaaatgtcttccaaagtggctatgccatcttggattcccaccaacgatgattgagagctcctgttgctctaaatccttgtgttttaatacaattttgtaaaagtattatagtccaagaatacgaaatgtgcccaatatagaaaattcaaatttatccctaatcctattaaaaaaactattttctgctactatgtgtgtatttatatatacacagtcatacagtgtatatatgtttgctttctgcctttttcatttaaagacacatcatcaaagaataccatgtttttgcacactcttcagaagagcacttttttttgggggggtgggcaggcagggagatggagcctggctctgttccccgggctggagtgcagtggcgtgatatcgactcactgaaacctctgcctttcaggttcaagcaattctcctgcttcagcctcctgagtagctgggactacaggcgcacgcttccatgcccagctaactttttgtattttagtatagacagggtttcgcggtgttgtccggctggtctcaaacccctgagctcaggcaacccgcccaccttggcctcccaaagtgctaggattacaggtgtgagccaccacgcctggctggggtagaagagcacttataatggtagattaattctgcattatttggatttgctacaattgaatagctatttctccattgtttggaattaatgtggtttttaattacctcatcataaataacaatgagatcaatgtacttgggcctgttagagtcctccatctaaaaattggttggatttcagaatatgctcaagtgcttagcacttttaagttttgaaagcaggaaataaatgttaaattaacatttaggaagttagaaaaggcccaaaatgaggatcacggaaaacccatatatgatacctactttgacccggtattctaagcacgtaattggtattaactcaagtaatgctcacaagaatctgaggagactttgaagcattattagcccaattttacagctaatgaagttgagtttaagtaacttgcttaaggcattgtacctagcaagcatgggattgatgattcaaatctatacagcctggctctaagcaatggtcttcacagtttcactccattgttgagagaacatttgacttgcatgatttaaggtagaataaaaatcttgatagggccatatagatctcattatgtcctctagtcttacatatggtctattgtctctttagattacctgtcctacatgtagaggcatttgagtttgcagccccatggcaaagtaatgaaaaacctattggttatgaggtcactagtgcagcctaacaaagacatggcccagctgcttatgttgcaagtgttggaaaactgatcaattttctaacatcacttccctaaaaatacattttggtgtgtggatgaataatgctgaataaataccagatagctatgtatactcacagttctgaaaatacatgatccccaacacaattttagttgtgccttggtgcagacgaattttttcacttttatttctctgagaaactattttaaacccacaccaacctcattaatttccacatcaaacaatagggctttgactatcagcagatgtttatactatctgttagccataaaaatttaggacactactcaaattgtaggtaacaaactaatggctctttttgcttgtcattatccaacatttttgttgaaagacccaaagtcaaagaggatggtccatgaactaaatgaattacaaatccatctaaggccaaaacagaagaatgtaattttaaagatactgagcctatgcttttacaacctgaactccctacaaaaatgtgaattcttatgaaagacaaataaaaatttattttcatagcatagattaggaaaattatgcacattttatagattatagacaaattaatatccactttataataggttatggcttactaaataagtaatgtttaatttaaaaattcaaattgtaaatactcaataatatttaaaatatttgtatactttttttttttgagacggagtctcgctctgttgcccaggctggggtgcagtggtgcaatctcagctcactgaaagctctgcctcccaggttcacgccattctcctgcctcagcctcttgagtagctgggactacaggcgcccgcctccacgcctggctaattttttgtatttttagtagagacggggtttcaccgtgttagccaggatggtctcgatctcctgaccttgtgatccgcccgcctcggcctcccaaagtgagccaccgcgcctggcccaaaatattcgtatacttaaaatagtagtcgaggctaggcgcggtgtctcacgcctgtaatctcagcactttgggaggccaaggtgggctgatcacaaagtcaggagattgagaccatcctggccaacacggtgaaaccccatctctactaaaaaaaaaaaaaaaaaaaaaaattagcatgttttatgactttgtttatgttctggttgcatatgtacattcactttaagaaagttattctagctttacacttatgagtcttgtacttttctgagtagatactgtatgtagttcaataaaaatatacttcaaacaatatatttctaagggaaaagagttctgaaatataacataaccattttgacatactaaaatatatactccatgaagcattacgttaactgcaatatagacacacacacacacatatatatgtatacacatatatatgtatttccatgtgtagatataaattgacataatctatgattgagtcatacgtactcagacaggcatggtggtgcgtgcctgtaatcccagctacttgggaggctgaggcaggagaattgcttgaacctgggaggcagaggttgcagtgagccaagattgcgccactgcactctagcctggcgacagagctagactccgtctcaaacagaataaaaataaaaatgaatagtcactgtttaacctttcttgtccagtttttgtgtttttaaaacatcctgcagaaatgtgtatctttccttggggttgcgggggtatacctgtgatatgtggctttttaaaaaagcttttgctgcttttttttttcccctttttttggagagagagtctcactcggttgcccagactggagtgcactggagcaatcattgctcactgcaaccacaaacttgcctcggcctcttaaagcactgagattacacgagtgagccactgtggaaggacaagctgcttttatttatgcatattaatttctttatcacacattttatttttaaaattatttctagtgtcttgagtttaatgttcattttttatttttcatccattattttttcaaatatgaaagaactcaacactatgaattgtccatggagtataaatttggttgccttttatagatttttataggtaatattctaattatttcattttattaatattttctaatggaagttccacattttccaattttgcttgagggttgcttataaaagttttgtttttatggttgtttattttcacatctgagaatgttttgtttttagttttgtgcataatttataattgggtaaactcttctgcaacatcatctctacctcctaccttgcatgctattctatagccaatcattttcttttatatttaccaaatatctcttaaatgcaggccataagtctgacacctcactaggatgtaataatatacatgaagcatacagtgtatctggattcaatgatcttacaatgttggtctagtggcatacagtaaacaaataagagcaggcatggtaaacatattgagatcatatatatataaaagttgagtggggtcacaattgagagaccgtgagatttcagagaaactcttcatagagatgaaagatgagaagagttttgaggggagaggtatttacctagtagaaaatatttggatggaaactttctgaatagagaacaacattctgtattctaaaatctaataactttgtagagggctccttcttcttctgtatgatctcctattctgtgctctttatcctgtcttacttccatctcacacagatacaatttttcattcactttctcttcttattttaaactttttccttctcactcaactctttccttccaaatttatgaatatatccagacggcactcattctaacacacatgtacacacacattcctcctcttaactcttcatcctgttcagctcttgctcttgcccataatcagaactttctgtcatgattttctcattgttcttgcttttctcaactcatcataatgtgactcttatcccaggaatggcaggaagttatttcgctgagatcaccactgacgatctaattgcaaaatctaatgggcatctttcattactcttacttttggaggcacacgatcatattatgcacatatatattgccgacacaatcccgatattatctggattaagattgtttgcatgtatgtcccttaatagactagaaaaatgtgagggtaagagatattatgtattatctatctttgatctatctttgtagccctaatgtttagatcagtgcttagtacataatagacactaaaaaatttagtgaactcagtggtgccagcaattattcagatattgagttctcctggggagattctttgtgatgtgctgatgcatttaggtcaactctgtccaattatcattttcatgtcctagagtcattctaaacactctagctcctgagcgtatgtattactttaatgatatctttaccaatgctttggtgtgttagtctattcaggcttctattacaaactaccattgacaagctgttttacaaacaggaggaatttgtttctcacagctttagaaaaccagaaagttcaagatcaaggtgccagcagagttagtgcctggtgctggccacttcctgcttcatagacagcattttttgttgtgtatccacatgacagaaagggcaggtaaatatctctggagcttcttttttaagggcactgatcccattcatgaagactctactcttgatgtaattatctccaaaaggccccacaaccaaataccctgacattggggattaaatttcaacatacagttttttggtggaatgcaaacattcagaccatagcaactgacataaatatgttgaatcattccctcattcaaaaggggttttccatctaatggatgtagatgttatgagtagagaatcagagaccccactgctgtggaagcagaccctccaaattagggcaatttttctactggaaggttttgaaagcttcaacaggccacaatagtttcatttgagacaaactctaattccatgtaatatatgtgtaatgtgtgatgtgcaaagtgtgtttgtgtgtgtgtgtctgcgtatgcatagacacatccgtgcatgtctgtttatctcatagggatcttggttttacacccaagaaaaaagtatggcttctcttaattctgcttcttcttaccagcccttagaattcaacctgcttcctgtcacagaaaggtatatgactatcttaaaatatgattttattagccccctttttctctattatgatcttggaaacttgtcattattattcagattagctttactactgtattaatgagataattaatgtatgtaaggatgtatgtgtgagtgtcagtgtgtgggtatttgcatgcataattttgtttttttcttgaatttcactgaacagatttgtcatttacatcatttggatacataatacattccatttgtgtaagtgttttttttttttttttcatcttttgaaaattaacaatggctatctggagccaaagattttaccagatagaaataaggtttctctttattatagaattgacattttcaatttttattataaaaagcaaattgaagtctttaattgcctgggttttatgaatgtattgaattttctaatttcaatgttaatggatacatatttctttctagatttcttttcttttaaataataagcaactggtttgacatgcctttaatcaagatttatcatgaccttattagaaagttaatgtttggaacatttactctctgatgaaccaccaattttgtattttacatttatctgcaatttccaacagtgaagaggttgtctgcaaatggaattaattcttctccatttggttatcatctcctttgctccaatccctggtaatagctaagcttgttcaagatattaaagaggtagatcaaggatctaaatggtagggaaaattttcaatttcttaaatttcatttattatgttgataaatctggcctctttgatagtttgtcattttcatagaattgattattcattagcaccattgcagaccatatagctaccatctttgcttaggttttctagcctctggatctgattgagaaaggaagacatttgaaagcatatctgagtacacatgactcaatcattgattatgtcaatttatatctacacatggaaatacatatatatgtgtatatatatgtgtgtgtgtgtgtctatattgcagttaatgtaatgcttcatggagtatatactttagtatgtcaaaatggttatatttcagaactcctttcccttagaaatatattgtttgaagtacattgttattgaactacagtatctattcagaaaagtacaagactcataagtgtaaagctagaataactttcttaaagtgaatgtacatatgtaaacagaacataaacaaagtcataaaacaaaattactagtgcctagaatcacccttatatttcctaccaggcactcacttcttacaattacaacttttgacaccatgtattatgactgaacttttgtgtacttccaaacttcacatgtggaaatcctaatacccaatgtgatggtattaggaggtagggccttagttttaggtaatgaatgtggatcccccacgaatgatgctgtgcctgaatgttggtgtcctcccccaatttgtatgttggaacataatatgcaatgtggtaataggtaagggaaagtaattaagggaaagtaattaagtcatggggactctacccccataaatgggattagtgctcttataaaaaagtttaaaggagcattctggtttcttccatgccttccagcatgtgaggacacagcattcatcccttctaccatgtgaggatatagcaagggtgtgccatctatgaggaatgggccttcgccagacacaaaacttgtcagtgccttcatcttggactttgcagactccaaaactgtgtgatataaacttctgttatttatacattattcattctaagatattttgttataacagctcaaacggactaagacaaatgaaaattgcccttataagaagataaaccacggcttcttttcttggtgtttggttttcaacatgtgaggacacagtaaaaagacatccttctgcatactaggaagaaggccataaccaaaatccagcaatactggcaatcttatctcagacttcccaacctccagaaccatgagaaatacatttttgttgtttaaactatccagtctatggtatttttgctatagcaggtcactgggaggattccccttcaatggaattgaatgcaattcagcttaatcagtgttcaagatatagcgctgtttctctgattaccaggattcaggggttcagacggaaattggagtggtggtaacattcattattacctctactgacctacaggcaaaaattttgtttcctgttcctgtgactttatgctctgctagcctaaaggtcttaattccagagggagggatgtttccagaaaaagacacaacaatgattgtatcaaactggaagttaagactgacacccagcaattttgggctcctcctgcctcagtcaataggctaagaagggaattactttgttggctgggacgaatgatcccaactaccaagaagaatatggactgtgactctacaatggtggggaggaaaaatatgtatagaataatagaaatcttgtacggattctcttattatgactgtgcactgtaattaagatcagtgaaaatcgaaaacagcccaatttaggcaggactatgattggcctaggcccttctggaattaaggtttggttaccctgccaggtaaaaaatgacaaccagctaagatgcttgctgaaggcaaatggaatacagaatgagttgtagaggaaggtagtttgaaataccagccttgatgatgtgaccggtttccaaaaggaggactgtcatcatcatgagtattcccttcttattttgttatgaatacagttgtgtttatacacaaatacgtgtgtgtgtgtgtgtgtatatatatatatatgtatatatgtaaagcaaatgcctttgatttattttctctgttattctataataatttaaaataaaacatattgactttatattagtatttaaatattgtcaatgttacatcatagtatttaagttacgggatgtcaggagaggagtaaacatcactcatttactttactttctcttgtgtggagatcaatggattttttgttgtatgcagaatagctgcatcatgtcaggaggaattatgaccattttcctgtcttaatttggagattaagtatggcttgaggagatgtgtacatgtgcccagttgacaaggggtcttcttgttatggttcatttaatgtgttgacctggactgtgctaagggatgctcagataactagtgaatcattattgtgggtgtttccatgaggatgtttctgaaataaattagtatatgtattggtgaactgagtaaatgtaaatgcccctgctcaatgtaaatgggcatcatctaatctgttgagggcctgaataaaataaaaaggcagagaaagggtgaattcactctctatgcttcagctgggacattcgtcttctgctgcctgtgaacataagtgctctggttcttaggcctttgcatttggaccgggacttacacagtggttcctctggtcactgggccttcatacttggactttgtcatttaacatcaactcccctgatgctcaggcctttggacttggactgaaactataccactctctttctggtcccccagcttgcagatagcagaacataggacttctcaacctctgtgattgtgtaagccaattccttataacaaatcttatatagctagacatagatagatgatagatagatagatagatagatagatagatagatagatagatagatacatagatgatagatagtaagtagatagtagatagatcgatcttctcttgcccctttttctctggagaatcctaagacaactggttgaacatcttttcatgtgcttgtttaccatctgtagatcatttttcagtgaaatgtctgttcataccttttgaccattttccagttaggttattattaattttttacagttgacttttaagactactctacatgttctggatataaatcctttgttagatacatggtatacaaatattttctccctgtctgtaccttggttttcttcctcttaaaagaatctttagactttgatgaaatctaatttataggtgtgaccattcgtgcagtaccccagtatgttgttatgctatgactaacctgcagtaaaatccatctacccaatttataatttcatttattttgttttttcaaaatttctagttaaaacaataaattctaatattctaatgaaatcattcacttttttctcttatctgccattatttgccttccaactataatatctggaatacctcagctctgttattattttatttgttaatcttccttttggttataggattctgtcttttggtaggaggaagtttttgacgaaggcaaggtattagttataaacgaagttacacactccatgtggtaatattttcctgcacacatagtttcgaatttcctctgctaagcagagagaatgaggactgttcactttaatcttaacagagagactgatttcaataggagcttcattgcactttttgtaaagcttggtagacttctgctttgacactgatcccagggtacatactttcaactacagtgtgactgagtctagaccttacaactgagagcctggtatcataactgagttcccttcactggctggtcctcagctttccttttcatctcctgagcaaaaataaattgcagaaaactttacaccactttacagagaatatcagcttagcttttcagcaccttgctacttgtagcttcagaatttggcaaactttttgaaaataaaacaatacacattcaatgcccagttttctgctatttaatatgttgaacattttgtgccataaagctttcaattttctctctagtttgttgacactgacaaacactttgcttatacctctgtctttcagcaaccattctgcctgagcaaagactggattttgagctctcagtccatttatgacaaaatggactcctgaggtaaaagtatctactcaactctcagtgtttcttctctctcccagaatcttgagcactctggtcttgtttctgtattagttccctaatgcttttaagaaaaagttatttatattttatgtaacttttctactgtctttttctctgtgaagcattggttggctttgagatactttatttttttgtctttttgaagtacttttaaaacactgaagcacgaaaacagaggcacaatcagttttgttcatagttgcatcttgcacaaggatactcgtattacataataaatttggaagataaatttgctgttttcaaataagtaacagactgcttttgtggaataaaaaagtggaaaatttgttttttttgtgtgtattcacagagtcgtttctatattttatctaaatttgtatattctaagtagaattgaatggacaaatcatttgttttgtccattattcatataatggacaaataattaatcattgtgtcaaatcatttgaagtcagtaacaaatttcctgattaaattttgtttgctgctctacacttgaatttttaataactttccagctattaaattgctatgttataacatcattttgaatattattgataaggatcttgttacaaactgcagaaatgttactaggtaaaatgagtgtttggcctagccaccacatatgcaatttagaacaatgtgatttccattcgttcatagaggtgcgatccccacctctagccaaagatccacagccacgcagggtgcatggtggctccccttctcaccccccttccctcctggatggggtgcttgggcggatccacggcacacacctgtgtctgcacatgtggggcgaggggtatgtttgcaatggccatgcagggtgggagagaactgtggctgctgcccaggccccagggcagtctcaggggccaggggcctcacgtggctagttggccagcatgtcccacccgccatcccctcctgccatgtgcccatagagtctttcctccccgggcgagaggtccggctttgtccgagccagaggaaggatacagtgatttaaggaatccatttgcatagaggaagaggttcttctccacctaaatcgattttttttctttttccttttctatgtgagaggtttcttttcctacctctgcactctgcttatgataggaaagcaacagaggagccatcccactggctaataacggcaaatttggcaaagtctgtctgggacttaatctaaataaatccatgcatcccccgagacacctttttgtcccaaactcaattacaaactttggttgaagccctagaaaggaaaaccagatctgagggatccaaagccaggcaacaggcacagagtaaatgggcaggactaattcctgttgattaagcccctgcttcatggaaggaggccatgttccatgtcatatatagataaggcctagggaactcaagagatttcatgactatgaattacagtaaaaaataagtactcttgcaaaacacagttggattgtttgtaacacaaagaataaatgcttgagaagatggaaaccctattctacatgacgtgattatttcacattgcatgcctgtcaaagcatcccatgtaccctataaatatatacacttactatgcacccacaaaaattaaaaataaaaagtaaaaatttagaaacaaacaaacatacaaaaaccaaaacacatcatacttcagttttgaaacattaaggtcccaattatgtttactcaaaaataggtttttaatttggtagtttttttatttttgagtgtgaatataaggccaagcttgcttctattcttataatttgagaatttaacaagcattgtttatttgtggacgtcaaactcttttttatttgacatatacaatataatatatataattataatattatatattataaaatctctactaaatagatatatttagtagagatggggtttcatcatgttggccaggctggtctcgaactcctgacctcaggtgatccgcccacctcagcctcccaaattgctaggattacaggcatgagctactgcgcccagcccctcactatctttatgagcagacacaacaaagatttattgagtaaatactatgttcagggcactattccatgtactaaaggatttttaaagataaataagacatggctcttatctctgaggtgttcacattctcatgtgaataggacaggcttatatacaatagtctaacacgaggcattatgtgaaaagtatatttcttcgcctcttctcactgcttagaaaagtgtctagaacatagcgtgcactcaattaatactttctattagcattaatattaatcttgtcatcattggaaaagatataataggaactgacactggagaaataagtcaggtccaaattatagaaagattactatggtagtcaaaatcccccacttctcatctccactgacactccaaccttgatctagatgtggttatacctccataatctctcactttgccgcacagtctccccattggtgtccttgactcttaatgtgcactcctccatgttcaaaaaacagaaccattcttaaaatataagtcaagtcatatgatacttgtgctcagaatcatcaatggattccaaattagataaaagtataagcaaaaaagccctattttgtcctaaaatgccctacagatctgtgttcccactatttctctgacttcgtcttttactcctctcttctttatttttctcaagttacaatgccccattggtattccacaaaaacggcaaacatacttctatctcaagtcctttgcccttgctattccatctctctggaaaaactctttacccaaatatcagcatgaccaactccttcatttagtccaagtctctgtgcaaatacctctgtatcagagagtctttaccttatcatcctatgtaaaacagcactccaaatgaccctctttaaattttcagtatgccactcatcaccacctcaaatattgtattcactgtgtgttttactttaactcttccccaaccctagattataaactctgtgactgaaaccgtaactattgtttgctactatattatcagcagtagaacagtgcttgactcatagtgaggtcttgatgaatttggttgaatgaatcacttaatcaattgtcccaactttataaactcaagtttaaggtatctgaaaattctagtctaatcccaaaccatattgatgtattggtccttatttaaacccttaaaaaataggcattaattgctttatcatgcagtctcttttaattagtgtaattttgactagattgatatgctggtttagtaattactttgtgattttatatgtatatgttacatgcttggattataatagaaatgctagattttaaagttactgaaacctataagaaagcagttttgtcttatttttttaaatataactcagccatcttttctgtacacacacatacacacacaacctcatagatgtggttttaccaatatcaatttaaagaagggcactatgatgtttgttttagatctgtacttcctaaattatctgtagtctaagaacagtttttctctccatctaccatggattcacacttttataaaataaaataattcattaatataaacttaatagagaaaagcaaagacatgagtcaagtctatgttttaaatgattagattcaagagacataaagttttctgtaaacatttcttttttaacattctgtttcaatttatgtacttatcacaaaccagaatcaaacaattcctggattagcactggtatccagacctaaatttgagtagcattgctttatatattaaatttcgaacacctctctacaaagtatttatattccagcttttttaaaagtaaaaactgactataagagaagttaacgtaatacagtaaagactatttaacaggaacatttgatgaagtagatcattcccgtcttctaaaaactttcactttctttgtttttcattacaccttgttcttctgatttgtgtttttcccctctgatttgtttcttttctgtttccttcacttcttcttacttatccaaagattacagtatctttgaaatatgttttgaactctcgtcttttctacatcaaaatacacttcctggctccaattgtgaactataaaacattgattaaaaatgtatatctaacttctgatctctctgcacattgtcacatttgactactgtattaatcatttttttaaatgttatgtattttatgatgtgttgacatcttacaaaggctactagccatgtaaagactgccagggccagggctagccaattctttgagttagtaaagggccaggttgggagcatgtcttgcatgtgcaatcgagccaatctttggtctatagaccaaagtctatagctccattcacagccttgtctaactctttacacaccaagccaagatttaccttgccctaaatcacctagggccaaatataaaaaaaaactggagaccgtctttatacctcaaggccctttcaaattattcaaaccagccaatattaagttgtttattctgtccggccttgcttttcccatagaaacccccataaagactctggctctggattccctttgcttctatctttttccatgtgagaaaagcctagccctctgtggtcctctgtgacatttggcgaccctactctgttggacctgtaaatataatcaaacctcttccttctaggccttgttcttgttttcctttgcagctacactgactgtaccacaccacatttttcgaacttttatgcgtgcccatatgcctcacaaacatatataattcaacatacccactattgaaatgaacattgtctcttcaaacgttttccttctgttaatatttcctacatcagcaaatggaaacatactctttcaataaacacaattgggaaactttaaagtcatccttgactagcctagtttatccatttatcttttattattcaatcaattggtaacaaagttctgcctccaaaatgtatctcaaatatcatttacttctctatcatttttacaaatatcagtatagtccaggacacaatcatctccatcatgaagtcctgactggcttcccagtttctgctcttactcatcattctgatctatcttccactaactgccacgtaatctactttttaaaatagggtaagattgtatcttgttttcctgagacaattgtaattttcatctattatctcatatagtgattaatggtaccccttcctttctattaagtgagacagtatgtacaatatattctatcttcacgctacctaatagtcattaaaataatttattgagccatgacaaagtaattggctccagaatagtttcattctcttaaaaaactagaaaagcatattaaataagttcgggctgtggaaagcagatagtaaaggatagcaatcactaagaaaagtgaaaacactgaagtaagtcctatgatcacccaggatttctccctgcgggtaactgtaggctatggtgcaaggacaggaaatccctacatatcgtagtagttctattaaattgaggatactgagttaagaaagccttaccaactggaatttgtcagatagagtaatagagaagggagggtgagagtaaaaaatagattcaggtccgggtgcggtggctcacgcctataatcccagcactttgggaggccaaagtgggcagattacccgagattgggaatttgagaccagcctgaccaacatggagaaaccctgtctctactaaaaatacaaaattagccgggcgtggtggtgcatgcctgtaatcccagctactcgggaggctgaggcaggagaatcgcttgaacccgggaggcggaggttgcggtgcgccgagatcacaccactgcactccagcctgggcagcaagagtgaaactctgtctcaaaaaaaaaaaaaaatagattcaaaaatgtacatatggattcccttgggtctttcactaaatgttaagctgaacatgcacagggtgaaattccataaggctagacagagagcaactgggagacaactgtatgctgaacaattcccagaattcacataggcctaagaggcattttcagtagctagagtggaaaaaacttgtttagcacctagggcattcagtgaagacaccagaatggctatttctaaaaagtagacctaaaatgtcctcagagtaaaggatacttctgactcatgttaacaacacttaaaaacaaaccttaaaagaattgagctgatgcgcgaaatcttatatcaactatttaaagaaataaagcaaaatccagacaaccaataatgttacattatcaagaaatcaattaataattagaagatgtgttaggaagcaggaaaatataacatataaccaaggggaaaatcacacaaaagaaatgaacacagaaataacaaacatgataaacagaaaaaaaaactttaaaatggctattacaaatgtgaagaaggccttaaaggaatatataaacatactgagaaaaaatagaaatatttttgttgtttttaattgtttttagacttttcttctatcctttttttttcaacttttattttgagttcaggggtatatgtgcaggatgtgcaggtttgttacataggtaaacatgtgccattgtggttttatgcacagatcatcccatcacctaggtattcggcccagcatccattagctattttgcctgatgctctcactcccccaacaccaagcctccaacaggccccagtgtgtgttgttccctgccatgtgtctatgtgttctcatcattcagctcccacttactaatattattattttttccgaggcagggtcttcctctgtcgcccaggctggagtgcattggtgcaatctcagctcactgcaacctctgcttcccgggttcaagtaattctcctgcctcagcctcatgagtagctgagattacaggcacgtgtcaccctgcccagctaatttttgtattcttagtagagacgaggtttcaccatgttggccaggctggtcttgaactcctgacctcatgatccaccctcttcagcttcccaaagtgctaggattacaggcatgagccaccgtgcctggccctcagctcccacttataagtgagaacatgtggtgtttggttttctgttcctgcattagtttgctgaggataataccttccaactccatccatgtccctacaaaggacataatctcattccctttttatggctgcatagtattccatagtgtatatgtaccatattttctttatcctgtctactactgatggtcattttgggtttattctatgtctttcttattgtgaatagtgctacaatgaacatatgtgtgcatgtatctttataatagaatgatttatattcccttgggtatatactgagtgatgaattgctgggtcaaattgtatttctgcctctagatctttgaggaattgaaacactgtattccacagtggttgaaataatttacattcccaccaacagtgtaaaggcatttcttattctcagcaaccttggcagcatctgttttttttgtttgtttgtttgttttgacattttgataacagctattctgcctggtgtgaaatggtatctgtattagtccattttcatactactatgaagaaataaatgagactggataatctataaagaaaaaaaggtttaatggacttacagttctgaatggcttgggaggcctcacaatcagggtggaaggaaaaggaggagcaaaggcttgtcttacacggtggcaggcaatgtgagagagcaagtgcagggaaactgcctttataaaaccatcagatctcatgaaacttattcgccaacatgaggacagcatggaaaaaaacccaccccatgattcaattgcttcccaccgggttccgcccacaacacgtggagattatgggagctataattcaagatgagatttgggtggggacacagccaaaccatattagtatctcattgtggttttgatttgcatatctctaatgatcaatgatgttgagctttttttcatgtttgttggccatatgaatgtcttcttttgagaagtgtctgttcatgtcctttgcctatggttttttttttcttgtaaatttatttaagtttcccctagaccctggatactagacctttgttagatggataccttgcaaaaaatttcccccattctctaggttgtctgttcactctgataatagtttattttcctgtgcagaagctctttaatttaattagataccacttgttaatttttgcttttgttccaattgcttttggcattttcatgatgaagtctttgcccatgcctatgtcctaaatggtattgcctagattttcttctagggtttttatagttttgggttttacatttaagcctttaatccatgttgagttaatttttgtatatagtgtaaggaaggggtccaatttcaattttctgcatatggtttgccagttctcccagcaccatttattaaataggaaatcctttccccattgtttgtttttgtcagatttgttgaagatcacttggccgtaggtgtgtggtcttatttcttagttttctattctgttccactggtctatgtgtctgttcttgtaccagtaccatgctgtttggtttactgcagtttaatttgaagtgtagtgtaatttgaagtcaggtaatatgatgcctccagctttgtttgtttttcttaggattgtcatggttattcagggtcttttttggttccataggcattttgaaatagttttttctagttctgtgaagaatgtcagtggtagtttaatgggaatagcattgactctataaattacttaaggcagtatggccatttttacgatattgattatttctatctatgggcatgaaatatttttccatttgtttgttttctctctgatttctttgagcagtggtttgtagttctctttgaagatgtccgttactttccttattttatcctcttcatagcaattgtgaatgagagttcattcatgatttggctctttgcttgcctgttgttggtgtatgggaatactagcaagttttgcacattgattttgtatctagagacattgctaaagttgcttgccagcttaaggagcttttgggctgagatgataaggttttctagatgtaggataatgctatctgcaaagataatttcgcttcctttctttttatttgaatactctttatttctttctcttgcctcattgccctggtcagaacttccaataccatgttgaataagaatggtaagagagggtgtgcttgttttgtgccactttgcaagggaaatgcctctagcttttgctcatttagtgtgatattggctgtgagtttgatatatgtgaatcttactattttgaggtatgttccttcaatacctagtttattgagagtttttaacatgaagggatgttgaattttatcaaaagccttttctgcattgattgaaataatcatgtgttttttgtcttttgttctgtttatgtgatgaatcacattcattgctttgcatatgttgaaccaacagtttataccctctcagatatgaagccaactggatcacgatggataagctttttgatgtgctcctggatttggtttgccagccttttattgaaaaatttttatatcaaggttcatcaaatatattggcttgaagtttttgttgttgttgttgttgttttgtatctctgccaggttttggtatcaggatgatgctggcctcataaatgagttagaggggagtccctcaattgtttgcaatagtctcagtagaaacggtaccagctcttctttttacctctggtagaattcatcctttagtccttctggtgctgggctgtttttgccttggtaggctatttattagtggctttattttagaacaatttctcagtctattcagtgactcaatttcttcctggctccttggtagattgtatgtgtgcaggaatttatccatttcttttagattttctagtttattttcatagaggtgtttgcagtattctctaatagctgtgagtagttcattggggtcagtgatatcccctttatcatttctgattgtgtatatttgattctgttttcttttcttctgtattaatctagctagcagtctattttattttattttatttctcttaaaaaaacagcttctggatttgtggggttttttttttttttgaagaattttttatgtccccatctccttcagttcagctctgatcttggttatttgttgtcatctgctagttttggggtttgtttgctcttgattctctagtttttgttaaaaaaatttgtgatgttaggttgttaacttgagttctttttaactttttgctgtgggcatttagcaccatgaatttccctctgaacactgctttagctccatcccagaaattctagtacattgtctctttatcctcattagtttcaaataacctgttgatttttatcttaattttattatttacccaagagtcattaaggagcggatcgctcaatttccatgtagttgtgtggttttgagttcatttcttaattttaagttcaaatttgattgcactgtggtccaagtcttttgcatttactgaggagtgttttacatctgattatgtcatcaattttagagtaagtgctgtggggcaatgagaagtatgtatattatattttgttgtttttgggtagagacttctttaggtatctaccaggtctgcttgatccagagttgagtcctgaatatcttcgttaattctctgtctcaatgaactgtctaatattgttggtggggtgttaaagtctctcactattattctgtgggagtctaagtctctttgtaggtatctaagaacttgttttataaatctgggtgctcctatattaggtgcatatataattaggttagttagcttttcttgtattgaacattttacctttatataatacccttcattgtcttttttttatctttcttgatttaacatctgttttgtcagaaactagaattgcaacccctgcttttttctgctgtccattttcttggtagatttttctccatctctttattttgatcctatctgtgtcactgcatgtgagatgggtctcttgaggacagcataccaatgggtcttgactctttatctagcttgccattctgtgtcttttaattggggcatttagcccatttacctttaaggttagcattgttatgtgtgaatttgattttgtcatcacgatactagctggttattttgcagacttgtttatgtagttgcttcattgtgccattggtctttgtacttcagtgtgtttttgtagtgtttggtaatggtttcctttttcatatttagtgcttcctttagaagctcttgcaaggcaggccttgtggtaatgaatttccacagcatttgcttgtctgaaaaggagcttatttctccttcacttatggagcttagttttgccaggtacaaaattctgggttgaaaattcttttctttaagaatattgacagccaggcgcagtggctcacacctgtaatcccagcactttgggaggccgaggagggcagatcacgaagtcaggagatcaagaccatcctggctaacacggtgaaaccctgtctctactaaaaacatgcaaaaaattatctgggcgtggtggcgggcacctgtagtcccagctactcgggagtctgaggcaggagaatggcacgaacccaggaggcagagcttgcagtgaactgaggtcatgccactgcacttcagcctgggcaacagagtgagactccgtctcaaaaaaaaaaaaaaaaaaaaaaaaaaaaaaagaatattgactattggctcctaatctcatttggcttttagagtttctgctgagaggtccactgttagtctgataggcttcccctttgtaggtgacctggactttctctccaactgcccttagcattttttctttcatttcaaccttggagaatctgttgattgtgtcttgtggttgatcttctcatggagtatcttactggggttctctgcatttcctgaatttgaatattggcctgtcttgctaggttggggaagttctcctggattatatcctgaagtgtgttttccaacttggttctattctccctatctctttcaggtaactcagtcagtcatagatttggtctctttacataaccccatatttcatgcgacttttttcattgctttttattcttttttctctattcttgtctgcctctgttatttcagcaagatcatcttccagctttgagattctttcctttgcttggcctattctgctcctgatacttgtgattgcattgtgaaggatctcgtattgtgtttctcagctccatcaggttggttatgttcctctctaaatagactattgttgctatcagctcctgtattgttttattatgatttttagcttctttgcattgggttacaaataattgtgtattttatgtgtcacaaagtaatattttgatacacatacacattataatgatgaaataagtgtaattagtatatccatcacctgaaatacttatctgtgacaggaacatttaaaattctctcttttaggtattttgagatatacaatacattattattaactatagtcaccttgctgtgcagttgaacatcagaacttttatctcttatctaaatataactatacccatcgaccagcatctctaatttctccatccaaacgcttacccccacagcctctggtaaccaccattctactctctacttctatgaatttgacttttttagatttcatatataagagatattatacagtatttgtctctttgtggccggcttatttcacttaacataggttcattcatgttgcaaattagagaattttctatttgttttcatcttaatgactgaatcgtattcattttacaattatatgtagtactttaccttttaaaatgcccatagttggacatttaggttattttcatatcttggttattgagaatagtgctacaataaacatgggtgtgcagaaatacctttgccataccgattttatttcctttgggtatatacatagtagtggaattttataattatatcatcattctattttcgttctttttaaatttttaatatttaatccttgtgggtacatagtaggtacatatatttatagggtacataagatactttgatataggcatgcaatgtgtaacaatcacatcctggtaaatggagtatgcatcacctcaagcatttatcctttgtgttaaaaacactccagttatactcttttgattttaaaatgtataattaaattattattaaccacagtcatgccgttttcctgtcaaatactaggtctttattcattctttctatttttttttcttttttttttttaactcattaaccatcctcacatccccccacccctgacacacactgagtacccttcccagcctctggtaaatgtcctcctactctctatctccattagttcaactgttttagtttctagctgccacatataagtgagaacatgtgaagtttgtgttttcattcctggcttattttacttatcataacctccagttccatccatgttgtagcaaatgacaggatctcattctttttatggctgaatagtactccattgtgtatatgtaccacattttctttatccattcatttgttgatgaaaattaagattgcttcccaatcttggatattgtgaacagtgctgcaacaaacatgggagtgcagatatctctttgatataatgatttactttcttttgcatgcatacccagcatttgaattactggactatacaatagctctaattttagatttttaagaaacttacatactgttttccaaaatggctatgctaatgtacaataccaccaagagtgtataagggctctcttctgtatatccttgccaatgtttgttatttttcactttttgaaaatagccagtctaacagatgggaggtaaaactcattatggttgtaatttgcatttctctgatgattaaagacattgaactttttttcatatatctgttggacattcatatgtcttcttttgagaaaagtctattcaagttctttaccaatttataagagttgtatttgttttattgttactaagtagtttgagttaattgtacattttggatattagccacttactggatatataatttgcatatatttttcccatcccatgtgtaatctcttcactctattaattgtttcatttgctgtgcaaatgatttttaggttgattcagtgtcttttgtctatttttgtttttgttgctcaaacttttataatcatatctaagtattctgcccagtgcaatattgtgttaggccattattgcattgctctaaagaaatatctgagacctggaaattcataaagaaaaaaggtttaattgactgacagttgtgtagcttttataggaagaatggtactggcatctgcttggctcctggtgaagcctcaggaagcttttagtcatggtggaaggcaacgttggagtagtcatctcatatggtgaaaatgtgaacaagagagagagtgggggaggtgccatacataaacaatcagatcactacagcaaagacagtaccaagccatgtgagatctgcttcgatgacataaacatctcccaccaggccccacctctaacactgggattatgtccttctgaaatttcaaaatataatcatgccttttcaataggacccaaattgtcaacacatttttgaattaactcaaaagtccaaagtctaaagtttcatttgagacaaggcaggttccttccacttatgagtctgtgaaatcaaaagcaagttatgtacttccaagttacgatggggtacaatggggtatagctattgaataaacatttccattggaaattgaagaaatcagccaaagggaaggccctgtgcaagttcaaaatcaaacagggccgtaattaaatcttaaagtttcaaaataatctccgttgaatacatgtcatgcatctggggcacactagtgcaaggggtgggcacactagtgcaaggggtgggcacactagtgcaaggggtgggctcacaaggccctaggcatttccacttatgtggctttccaggtttcagtccccatgcctgctctcacaggttgttgagtggctgcaacttttccaggtacaaggtgtaagctgcaggtggatctaccactctgggggcctggaggatggtggctcctttcccacagctctactaagcagtacctcagtgggtacactgtgtggtgccttcaaccccacaatttacctccacactgctctgtcagatgttctctgtgagggctctactcctgcagcgcactttttcctggggacccaggctttctcaaacatcctctgaaatctaggcagttgctgccaagttttctttactcttttactctgtgcacctgcaagattaacatcacatggaaactgtcaatgcttatggcttaaaatgtctgaagcagtggctcgaccttatcagcctggactttaccgtccatatcactatcaatattttggtcacaaacatttaaccagtctctaagaagtttcacgttttccttcaacttcctgtcttcttctgagtcctccaaagtcttccaacctttgcccattatccagttccaaggtcgcgtccacattttcaggtatctttatgaaaataacccattcctggcaccaactttctgtgttaagctgttcttgtattgctataaggaaatacctgacactgggcagtttatacaaaactaggttttattgcctcatgtttctgcatgctatacaagaagcctggtaccagcatatgctcaacttctcatgaggcctcaggaagctttcattcatggcagaaggcaaagggagagcaggcatttcacgtggcaagaacaaaagcaagaaagatagttgggggagaaagaagagatgtcatgcatttaaacaaccagatgaccattacaaagacagcaccaagccatgagggatctatctccatgacataaaccactcccactaggccctaccttcaacactgaggattacatcacaacatgagatttggagaggacatcgaaactatgttaaatgtcacacagtttttttttttctgttttactctagtaattttattattttaaatcttatctttaagttgttgttctatttttagttgattcttatataagggtgaaatcagggttcttttttttcttctgtgtatgaatatccggttttcccaacagcatttattgtagagattatcctttctccaatgtggattcttagcacctttgttgaaaatcaactcacactagttacgcagggttatttttggactctcttctactacattaatcaacgtgtctatttttaggccagtatcattctgttttgattcctatagctttgtaatatattttgaaatcccattgtatgattccattagctttgtcctttttggtcaagattgctttgagtattaggtgttctgtagtttcatatgaattttaggattttttctagttctgtgaaaattcccattggaattttgatacggattccattgaatttatagatcaatttgggtaatataaacattttaacaatattaattctactaattcatgaacatgggatatctttttcatttacttgcaccttcttccatttctttcatcaatgttttatagttttcagcttacagtttttcactttcttggtaacatttaattataaatatttttattgtattataaataacactgttttttaaatttttttctggtgagttaattgttagtgtgtagcaacactactgatttttgtaagttggtattttattttgtagcttaactgaacttttaaatatgttgtaacaggttcttagtggagtctttaggattttctatatgtacatacattgacaaatccgaaagactctaattctgtaatggtggtggataaattaattatgtgtctattataaagtgtaaaaacaaaactattaaaaacaaagcaacaataatttgttaagaggcacatattataaaaagatgtaaagtataacaccaaaacagtaaaaaatggaaagagagtaaaattacagaatttttctctgcaatcaaaattcaattattctaaacttgaaatagcttgttacaagtataaaatgtttcttgtaaacctcagggtaaccacaaaacaatattttataacaaaacacaaaagaataaaaaagatatccaaacaatgcagtacagaaggccatcaaacatcaaagcaaaaaagctagacagaaataaaaaaaaaggccctaataaaacaccagaaaacagttaacaaagtggcagtagtaaatccttacctataaacaattacaaaaaaaaagtatatgaattaagtgtttcagttaaagggcttagtgtagctgaaggaatgaaaaaaacaaagcccagttatatgctgcctacaatagactcatctcaacctaaaggccactcatattaaaagtgaattgatggagaaacacgttaaagggagacagaaactgaaagagatcagggtagctatatttcatttataaaaaataaactttaggtcaaaaactgtaaaaagggacaaaacagttaatgacaaagtggtaagttcataaggaggaactaacaattatatttgctccaaaattggagtacttaaatacaaaacaataataataaatcgaaaggagacatggaatgtgacacaatagtaatagggtatttcaacactccactttcagcaacagacagatcattcagacagaaaatcaataagaaaacatcagacttaaactacacgtaagaacaaatggacctaacggatatatacagaacattccacccaatagcaacaggatatacgtttttctcaagtgcacaaggaacgttctccaggatggattatattttaggcaacaacacgattcttaacacattgaaataaaaagaaatcatatcaagtatcattttccatcgtaatggtgtgaaactggaaatcaataacaggaagagtcatggaaaattcacaaataagtgaaacataactaatacactcctcaacaactatttagtcaaagaataaactaaacaggaaatttaaataatatcttgagaaaacaagaatgaaaacagaacataccaaggcttatgggatgcagcaaaagtagttctaagaagggagtgtataacaattaaaatctacatcaaaaaagaagacagctctcagataaagagcttaacattacatcttaagcaattagtaaaagaagaacagactagtcccaaagatagcagaagaaagaaaataacaaaggtcagagcaaaaataagtgcaataaatacatgaaaaaaatagaaataaagagaataagagttggctttttgaaaaggtgaataaaattgacaaaaccttagctaaactaactaagaataaaagagagaagacaaataaataacatcataaatgaagaatgagacattacaattgataatacagaaatacaaaggatcataagagactattgtgaaaaattatatgccaacaagttaaaacacctggaagaaatgaatcaattcctagaggcatataacttactaagacttaatcatgataagatgggaaatcttaacagaccaataacaagtaaagagattaaataaaaattaaaaagtctgttcaaggaaaagcccagatccagatagcttcatggatgaattctaattaacatttaaagaactaatgccaatcattctgaaactcttccaaaaaattgaagagaaaaagagtacttccaaactaactttacaaggccagcctcaccatgataccaaagctagtacagtacactacaagaaaagaaaaactgcaggctaatataactgataaacatagatgcaaaaatcttcaacaatatgcatatggactccaacttagggtggttcaatttaagattttttaactttatcatggggttatgaggataatatcttcaacaatacattaaaagtgtcatcatttaccatgatcaagtgggatttatccctgggatgcaagattggttgaacatacataaatcaataaatgtgatatgtcacatcaacagaatgaagaacaaaatcaacaccatcatctcaatagatacaaatgaagcatttgacaaaacttaacatcattttatgataaagtctattaacaaattaggtaaagaaggactattcctcaacataataaagactatatatgacaagcccacagctaacatcgtactcaggaattaaaattgaaggcttttcctttaaaatcagaaaaaaataagtatgcccattctcactacttctgttaaatatagtactggaagtcctagccagagcaattaggcaagagagagaaataaaggacatccaaataaaagaggatgaagtaaaattatctctgtttctttgcaaccacactgttttaattgccagcaatgacatgattttaaatgtcagtaaaaggcaaatatgaatttttcttcaagtacaacaaaatcaaggaaactatgtagttactcatcatgtttttcaaaggcttaatagaaattcatgagacaaaattaataaaataaaaatataactcaaggcctcaaaaatttataatgattaagcaatagaattatctacagtcaatctaatgtatttacctctacttatctccccatggtccaaagaaccatcgtctcagacctaaattatttcaaaaaaacttctaaatgctacccctgcttcttcccttgctactcatcacagatgattttttacaccacaggacaaacagtcttgctaaaacgtaggtcacagaatcgttctttgttaaaaattttcagtgtttttctatttcacttttaaagaaacaaatacattatagataaattctaactaatatttaaagaaccaccacaccaaaaatctcacagtttttaacatctctgaattcattaattatttatttgaccatgctggcctctcttgaaaaaataaaataaaataatattctaggcacgtttctacctcatagcccttgcacttgctcctcctgctgcctggaacagtcttctcccagatatcctcatgactttcctccttaccagattctcgtctttacttaaatgcccccttttcattgcagtcttccttgtccatgctacaaaataatcctgcccctttatcttccttttctactttactatttgatagcttttattccatcaactacactacctattgcatttattaactttctgtctacactaatactacaatgtaatctgcacgagtatgttctgtgcacttacgttaagtgaccaaatggcttaaatttagtagacacttaaatttcagttgaatgaataaatttctttggtcctctctagtgttgatattctgacagctaatcatattatacataattgttttgttgatggaaccaccctgttacacgtgattttaagtctattcacaagtccagtcctggcaaatgtttaacaacaagatttctgatgaaaaatgcccttatttgtagaattttattaattccatggtgaacattctctcaccacaaacacgggattgagataaaatgcacacaactgctttttatgagctgatgttggcacaaattatagcacaaattgcattaactcatttaatgtgctcaatcaccatgggagacaggagttattactttggccatttttcaaatgagaaactacaacacagagaggttaagcatgtacccaaggtcacatagttagaaaggaatctacctgggatatgcctgatgattgacccgagagcttgtgcttagaaaaattcagctatacttcaggcctttgataaattactttaaataaaattcaggttttaaaatgaaaaaaaaaaattatagccatgcatattctttaagtgtcagtcaaggacctataaatattttttaaattttttgaatatttaaaaaaatgttagttttccaagcaaaaggccaagactgtgtgctttgcttaggccattttattttcagacactgaaaatatctgtaaaaatgataatacctcactctggtttgccagagccaattagatttgtcagtatcagtctatatcttattgatcgaaaccgcaggtagtaaaaaacattcgtgtgttttctaagtgttctttcttgttttggattccttgcttaaatcagaatcttactgaactagaaataagaaagtttagactccctccttgtttttaggaatataatgtacctagctgagtggatttctatttttcaaaggcacaataatccagttaaaatgcagtgattctcttaggtactacatagattttacattgtataatcattgcaatcagccaccaaatccataactctcattagaaagcagtgtttcttttaataccattaatttagcctgttttgaagtccttattaagaattcacctagctaaaccatgacacttatatggattcgacaaacttgctctattgcctctagttctgaaaatagattttaattatcatataagattaattaaaagaaaaatgtaattcagtattacctttattttttacatcatgaagcactgagtaacaacatctatatactacgcatattgtgtataaaatcaatgaatgtataatagctgtatggaaaacaggtttaaatctaaaccaatgaaccacagcactaaaaaattaagcaaatgtttattacatcattttggatattgacctttggatatagaaagaaaacattttgaagaagaatctgagtctccacattttatttttagaggagtaggtacttctggacaccatctggtcagcccatggcattcaaaataaaacagtgtttggaatattgaaattaattattaaaatgacaaggagaattttaaatttctaacttgcagacatgggataattttgactatttctggtataaaatgacaggaggcatatctttctggcagagttttgatcttgtgaaacagctgcaacagaaacacatgaatgtttttctaaaaactagatttcaatctccacttcaacttactggatcaacatacataggtaaggctcttcaaacctagaatgcaaggatttaacgatgctgctattaaaaataaagtaactaatttctttcacataaatcattatttgttaattttcaaatggattatacacccacattttatttctttttggaatcaaaaatggatttagggccaagattttagtagaaaagaggtttctttgtagaaaaaaatattgcagaaaaaatactagtaaaaacattggacacaaaaatattagtaaaaacattggatgtgatagaaacagaagtgttaaaagaaatgaagaacaaatcggggcatggaaaatgtatttcttcttaaaaatatttgtaaaagcatgagatgcagctatctttacaattaaattaaatgtgtataaatggagaagactgaactataatccaaatactcagtaattctagtgaaatttgacatatgatagatcaatatttgtgaaaagaatagtttaatcaaaatactaggtcaagtctcttcgcaatttttctttatatagttgaaattaagagggacagcctggagaatattctaagtgtggcggggcctataatcacaataaaatattgatctgctttctcagatgatggcattttggatacacaccactctaagaaattaatcgtacaaaagcaataaatgttcatttgtgagatagtatgtaaaattctgatagaatttggtcacttattgttcatttttaaagtcaaggaataaagaaacagtctatgaagagtttcagataaaaaaccaaatgataggctaaacgtaaagctgagcattagtgttacttgacattctcaggcaacctgcaatgtgttatgaggcccttacttaattttcagttgagataagaaagttaaataaattatcattcatagaagtcattaaaacaaactacacccatgcattttccagccagaattcactgtaaaattttcattatgtgaaaaaaacctgatgaataagaataatgactttttccataagttggcacacttcccaggctagaacacaggagaacctatctaccaaaaactatgtccttctactcccttcaatgaataaactactgttttttttaaaaaaagtttatttctctcacacattaacaaagattagaagtaaacagttcaagatttgcatggcaactctgtgattatcagattatccttctactgtcaaaatgtcatttccaccttctggaccaagatggctgcctgaggtctagtcatcagagctgcagtatgatgaacaggaaaaaataaaggatgaaaaagggagcatcctcgtcctttaatgactctttcacaacgttgcaaacatcaaagagtgaactgatcttaatccttcaaaataaacaagagtcaggaggatttcaatttgaatcccaagtgtattttgggaatattttataagactaaaacaaagtgttttatgttccatgcctcagtttctctagctacaatgaaaatataaaattctgtattattcatcttccttactcaggggctagaggtgataacaagaagagattgatatgcagttcaaatatagacatgtgatagtgatacttcataacataaaaacaatattttatgactaatgggcagaataaatccttcgtctttctggcacaatatgcataacttaaaagaatgtcagagaaaaaaaaacaacattagaatggaagttgttaagaactatttaaatgactttataaccgtgtataaacttacctagaatagggatgcattgaattgttttaaataaaaaattttcttaggtcagaagggaaatcatttttgtgactgtgtgaaaaatacattctcacattggataccattccacaattaatctactgccctttttccttatgcccattatattacgtatgtattcttggcattcaaagactgcacatggtattactctgttttgcctatacttttaacaatatatttcaggacctttttactgtgattcttcaggatatttcaaaaagtattatgaaagatggtagacctagctgctggataactgtatttactgacaataaaaattggtccacttaaattttaaggagataagacaatctcaagtgaaatgaaaatcaataactggtccgtttttatctgacatactagctaagccacatattagagattaaagttagaaattaaaatgaacacaatatggtaatttcttttttggtgttagatgttctttcctccatagaagagatgtgttctagacatttttttgtgtgaaatgaatttatgttaagtgaatcttcctttctgatagaaaattaaaaatttattctgttgattataaaacaagttcttacggacttgacctttgacaaatctcctattggtgcttggtaccagcatgagctaactttatggcccaaagcaacaggacagtgtgctgaggtctgggagcaccctctccagagaatccctaatgtccaaaaattggtcaaaatctaaaatttattttgctgtacaattcacctttttttctggagttgtatttgccttcaacgagtaaggcaagatttcctgcttctgtgatgatggaaggccaataactcctttatgaagtttgattttgctcctgcagggaagatgagtttgagttttttcctgtttctaggatgatagagagcagtcttcagcctgagacccatccctaggtaaatagctgagttagggttttgtcttggctaaggtgtaacaaccagctggtcttaatttctctctaccattagaacattctgcgatcatattgttggggtattttgttgttgttgttgtgtgttctggtctttcttccatcagatttgaccaactctacctgacatggtcaaattcaagtgagaattccaaattataggtaataaagctgctctaatctggtcaaacttcttcgcagcttcaaaagaagaaaaacaaacaaacaaacaaacaaacaagaaacaaacaaaagtgctcggtttctgtgtttgcttcctgtctttaaaataaaatgttattttgtgtacttttcttccaccctatatctccttctccctttgccatctgcagtaccaaaaaaatctgaagaaggcttctagtgacttgaatccctttaaagaattcaaaacaaaggcaccacccactccttttggggtgttctgttttctttgtggagtttcaagagtcataggcagattcttcttaggtctattgctctgttttcttatgtgaaaggaaaatatcttgggcccccaatgttactaagctaaagaaaaaaataaaattcaagcttggaatttcttagggcaaacctgccttacgttctattcaaagtcatttctctgttcactgagataaatgcaaatctgataacttcctttaaaaaggttaatcagaaactcaaaagactgcaactgtttgtctcccacctacctgtgacctggaagccccctccccactttgacttgtcctgcttttgcttccagttgtcctgcctttccgaaccaaacaaatgtttattttacatacgttgattgatatctcatgtctccctaaaatatataaaagcaaggtatgctctgaccaccttggacacatgtcgtcaggacctcctgaggcaatgtcacaggtggaccttctcaaccttggcaaaataaactttctaaattaactgagatctttttttatcccatatatgagcaagtattgtacctagagtggacaagtccctcctcttactttcaggaacaccctactctgtctatagagtagctgttctttcaccactttactttcttaataaacttgcttttgctttgcactgtggactcggcctgaattcttttttgtgcaagattcaagtaccctctcttgggtctggatcaggacccctttctggtaacactgttaaaacacagaaaagtattgatgttgcaccgttcacattacctgaacgtattggtctgttttaaggcatttcttgagattatgcatgaatttttacaattggcttggaagggaggcaattgaagtatgaaagtgaagtgtaagaaaatatatcctggactggtagtgccctggcaactgtctgcttgtgttgagtcctcttctcccaatgtaaagacttgttatttgacattcagaggtatcatcattaggacacattagcaaaatagtgtttttgatattgacaaaagattatcatgatgctaagactagcaaaatattgagaattagctagcttcaacaagcctgaagtgaagttatatatgcatatattagttagcgttgctttcaggaaaatgagtatcaagttagatattagccagttatgaatgtctcattttaactaatgcaagtgatgttactgagttttcaactgaacacatgcagttgatgtatttattaatatttgaaggtagaatttgagactatttgatttcctgaagtttgaaatacgttttcataaatccttattgacaaacatgtatatgtctaaaatatgttttaattagcttaatatttattaatgtaacttttgactatactataaaaagtcaaagggcactaaagcgcttatggagaatagcagtcccatgtgccactcctccagagcaagcacttttaagttttatctcttaattcatgtgtttgcttccacatttttggataatagctttgattgctatgtttgtattttttctttccatataatatgtattgacttccttttttggtagatgagaatttagttatctcactctactttatctctctttcaacattatcaatagaattacatttcaatttttcttaaattaatattcagtggttcatttgtcaggagtatgtaaatactgcccacaattgggccacatagggtgctgtagttacatttgcttttttgtacaactctttgtcatatcccagtgttaactttccatctttttattggcctaattcaatttaatttaaacattattaaatatgttagatctgtaaaagaccttttaatattattttttcaggcattcaaacaaatgaactcattgattcatttcttttctttctttttctctcaagggtttcttttgacattctctggtcttcttgatctcagctggatctggagctctctaagatgaaattgtagctgacaatgactttcctcataaatctataatagcttaatataagctattatgtaagcctaataaagcttataaggggctttctatattaagcagctattctttgtattgcttacccttctcttttcctaatttactacccgattttatgaagcccatatgtggttggcaaaattatttgaaggcctcaaagattcctgactccttattccagttacttatcttgtcccagttattcaatcaaattcaaatctaggtactgctgtgtaaggatatggcagatatatttaagtgtttaaatcagttgatcttaagatagggagattatctgggtgtgtcagggctaattacaagagccctttaaaatcagagccttttctccagctggtcatagaaaagaaagtgagagttatgaagcacaggaagacctcaagtcagtgttactggtttgaagatggagaaggtcgcatgctaaggtatatgggaatgtgggcagcctctaggacatgaaaacagggacattacatctactaccatgaaaatttgatttttgccaacaacctcaataaactggaaagcagattccccctcagagctttcagataagaccagtctttctggcgatattgatttcagtttcataggaccttaatcagagaattcagctaactccagccaaccccagctcagacttctcacctacagaaatttgagataataaatgaatgttcttttaagctgctaaatttgtggtagtttattatgcaacaatatgaaactaacatgacatcattcatcagtttcttgagataatttataatttcttaaatgcttaaacctatatttgatactgtgtttaatatcttagtttttacttgtcaacatattccatatttgaatatcaagatacatctaatggtcacatactaaaatagatttcttaggtgtgtttgaggtgagtacctttttaatcacctaagatatggtgatggagtctgtatagtgttgattcaattaaagtttacatgccatcaaatgtacccaaacttaaacctaggaaaagtggtagcagcatcttgaagatactgtgttatcttttttgtataagtttatctatcatttataaatacctattgtgttctaaacatcatgatataacctgcgaggaaacagcaattagcaagattaagtgtggactctagtgaccagaatatgctttgctttgatgttttaataattatgcaagcttttttcaagaataaggaatgcgtcgtatactcatacctcctttcaaaaagttgagcagtgaaaaaaattaatcaaagaatgtattgttttgactctataatggtaaacaatcaatttatttttttcttactaaatgactttgttggtgaaacgtagcagttgtcatattacgacttctcttgcttcagaaattaatgaaaaacacactagtctcctgaacaagtcatctcagataactttaacaaatctattgaaaataacatcttggtttttattgatattcgaaatagcactggataaataaatgcataaaccttctcagtttcccgttactctaaatggaaaagttgtaaaaccattcctttatattcgccacaatggcagatctgttccatgaatggtaatgcatgttttaaggtattaacaaaattgattatgtaaccctagatatataatggaacagaaggctaatgcttatgccgattctgccttaagtaaaatccatctgtttactactaaggtagcatgcaactcagctttgtttgaatagaacaagatgaatacttgaggctattttctatctgctaagacaaaagtgtagggaaacacatagtaaaacttatattttttaaagacacggttcccagcaaactctaagtatttactgtctctcgaatatgatcaacccagaaaagccacatgataggatacttgcaaatcttcccataaaccccagtcaacaatcatgtgcatacaagtcctggagacactcacagagaagcaactgattattgaattttatgtggaaggaattgagatgaacagttaaagggaaatttatattagattttttcttataggtctgcagatgttttctttttggaccattataaaagcatgaagcatagctttgaaaatgttattttaaaaaatatgtttctgacataatcatttatttctgaagaaaatgctttgttcatattatagttgatattttcaatgagatgttttgattagccttatcaactcttcagtatttgccaaataccctccacccacagtcatgtttcttttgtgtatatagttctattaaagtctggtaatttttgagatcaagatcaaacaatatttcatttgtgaaaccttctataactgctgtgctttcctctgcacttgactatgtttgcttaaacttctaatagagtgattatttcctttttccttgctatgtttttaatgatgtatatttccctcaagtcggtcaaattgcaagctccttgaaaacaatgatatgcatcagaaccagaaccttcatacaagactcacatagtggtgacttcataaatgccctgttgaattgaatcttaaaaagtaatccatgtcatccatcagcaaggaaagaacaattagtatatcttgattgcggatcatttgtttccttaaaattacccagggagaaaaaattggatgaggccaagagtattcctcatagtctgctaaatatagccacaacctagggtttcataggaatagcaagaaaagctcttggacacttgaaagagaaagagaagatacagcaatgcaggactgaggctgataataatcagcaaatttacaaaagacagaaatatttaaaacccgtagattttatctctttgaattactgttttatatttatgtcttatgtattacctaccagaatgttgttcatattcacattatataaatgtgaaaatactttgtgaaattctaaggttacattgaaatgacttctatcattattatattacctaaccaaatattggctttgtaagcatctctttctgacatctcaacaatcaatccccaaacaaccaatttcttttctagtatcctgctctttaaaagcaccaaagtataggtctatactgtttcacaggcagaaggtcccaaagaagttattaaacatcccctcacaggaaagaccctgaagaaatatccctttgaagtcatggcaaacataataattggcttggtaattaaggttttgtattcatgtaacaaagttttcagtaaagcatttattagcatttatcagtacttaaagaggagtactctcagtttcaagaagacctcactattgtcataagatagaattgaaccaatatataatttgcaccgcagtatgtaacaagtctcttttagaaacaagacaacctgcatctcttattttttatatttccgttaaaataatagatgagtcgaaagccacttaagaatttacaagagttatatttacaaacaaattcatacagataacactgttgttttgtgcatttacaaaacacaacacatttatttagtcttccgcatgaaaagccagttaaagtagcttgttaccaaaaatgtgtttcaggagttgcctggctcccttataacttacaaaacttaaccatttgttacctaaactaaaaaagtagatcaataattgttttatttggaggaaagagtagcttccacgttaagaaacgatatctaagagaatatgatcttcacatcagtgctaagctctgtttctgcatctgtgagttaaagtctgttaaaattgcttcattataaatgacattcaatgactgaaggtctacacaagaggagaaaacggagttctaaaaagccactggtacatgctgaagagttcagacaactaagcaatcattttgccaaacaactgttttacctatgccaaatttctatcaggttctcgaggcacaatgaatgcctttttatttttaaaacaatttttattttatttttttaggttccgaggtacatgtgcagaatgtgcaggtttgttacataggtaaacatgtttcatggtcatttgctgcacctatcaacccatcacataggtattaagcccagtatacattagctgttttccctaaaactctctcccccaacagtctcccccaactggcccccgtgtgtggtgtgcccctccctgtgcccatgtgttctcattgctcagctctcacttataagtgagaacatgcagtgtttgcttttctgttcctgtgttagtttgctgagaataatggttttcttgaatttaatacaaaataacttatctcaagagaaaatacggataacctcttttgcccaacactgagaattatgcaacaaagacaaggttgcattctagatgttgcaggaaagtttcaactttgtgatttatgtaattttcagataatacatttcaatttgtgttcagtatatagaactgatgtacctcaacatttctcctatgtttttcttttaactgataagaatgcagaatactcaattcagagcccaattattgtatgtaattatctgctatgattaacaatatcaaagtcattgttttcattttattgattttgttgtaattttatttttgattattctcttttgcattatgtgtaaatttaaaagccacaaatcattttttgaaagaatataggacatcgtaataacttccagaattccttggaaatttcctgaactcttttgtttcttagcctatttaataaaggctgtgtactttcatagaattcacattttgtattttaattttaatcctagaatttggtttctcagacttcaattaatgattcctggagggcagtaagaaaggcagcctgcaatttcacaaaatcattgttctatttgatgatttgttataatcaaataagcatttttttaaaatttatttatgtctttgagatgggggaaaacttataagtagataggcagtgatggaacttaaacattactgtatacatttgaacaaatatatttaattgctagttaatattgttaggttctgtgttcctacccaaacctcacattgaattttaatccccataatccccacatgtcgtgggagggaactggtgggaggtaattgaataatgggggcagtttctcccatgctgttcttgcgacagtgagttctcaccaaatcttatggctttataagtgtgtggcatttgccctgctggcactcactttttgtcctgcagcactgcaaagaggtgacttccgccatgattggaagtttcccaaggcctccccagtcatgcaaaactgtgagtcaattaaacctttttttctgtataaattacccagtctcgggtatttctttatagtagcctgagaatggactaatacagtaaattggtaccgaggtagtggggtgctgtggtaaggatacctgaaaaatgtgaaagccactttggaactgagtaacaggcagagtttgaaatagtttggagggctcagaggaagacagaaaaatgtgggaaagtttggaacttcctagagacttggaggcctcagaaaataggaaggtgtgggaaaggttagaacttcctagagacttgttggctttgaccaaaacgctgatagtgatatggacaatgaagtccaggctgaggtgatctcagatggagatgggaaacttgttgggaactggaataaaggtgattcttgcaatgctttagcaaagaggctggtggcgttttgcctctgccttagagatctgtggaactttgaacttgagagagatgatttagggtatctgggggatgaaatttctaagtggcaaagcattgaagaggaagcagagcacaaatgtttggaaaatgtgcagcccgatgatgggataaaaaagaaaaacccattttctggggagaaattcaagcctgctgcagaaatttgcataagtaatgaggaaccaaatgttaatcaccaaaagggagaatgtctccagggcatgtcagaatccttcacagcagcctctcccattacaggcctggaggcctaggaaggaaaaatggtttcttgggccaggcccagggcccatgctttgtgcagctttgggccaccgtcctccagaccctagaatggtaggttaaccaacagcttgtgctgtgccgtgcaccggaaaagccacagacactcaatgccagccaatgaaagcagccaggaggggggctgtatcctgcaaagccacaggcacggagctgctcaaaaccgtgggagccgaactcttacatcagagtgacctggatgtgagacgtggagtcaaaggagataattttgggactttaaggtttaatgactgacccgctagatttcgaacttgcatggggcctgtaccccctttgttgtggccaatttctcccatttggagcaggtatatttacccaaagcctgtatcccaattgtatctaggaagtaagtaacttgcttttgatttcacaggctcataggcagaagggatttgccttgtctcagataagactttggacttggacatttgggttaatactgaatgagttaagactttgggggattattgggaagtcatgattatgttttgaaatgtgaggacatgagatttgggaggggccaggtgtggaatgatacatttaggctttgtgtccccacccaaatctcatcttgaattatagtctccataatccccaagtgtcctgagagtgacccagtgggatgtaattgaatcatggggacggtttcccctttgctgttttcgtgatagtgaggagtgagttctcatgagatccgatggttttataagcgtgtgacatatcccctgctggaactcattttttctcctgttgccttgtgaagaggtgccttcagctatgattgtaagttttctgaggcctccccagtcatgaggaactgtgattcaattaaacctcttttcttaataaattacccagtctcaggtatttctttatagcagcatgagaacacactaatatgctagcttaaattagcaaaccatttaaaatcaactaccccaatgtggtgaatcatacctttagcccagatatttcctctgaataccaaggacatgtttcagtgggcctattcaaaatctccacttggatgtgtccagggcttcacatgcttaaactcctggtagatgctattatcatgatcctctttcacatgtagtactccaacagtctcctaagtattctaccttccaatttattatctctgcagtaacaggactgcctttttttcaaattgcaaatctaatcaaacctcatcatcatctacaatcttctacaattaaataacttcacatcactctgtggttaaaagaacaaaaataaaaactttggatcatgaccttcaagtacctgtggcttccccttaccactttagcttcatcttcaactgtttccccatgatttctactctagtcatgctggccttctcatatgcccttgtacttggaaagttcctacctaccatgggttctggaatagtcttctcttcctctttctcttcttattcattcttactttatagatatcacctccatcagcacagtcccagaacttcaccttccctgaattccaagtctaggtcaaaaccactcatgacatcaggtccttctctttgtggttattttattaatatctattgcttcttatgagattttaagtaataatgtaaggaattgtgtctattttttctaaaagttgtatctaatttccaagcctaatgcttggtttatagtaggtattcaatataacattcattggatgaatgaattggggttaatagaaagatgtcaatcattctaaatgaagtcattctaaatgtaacaatcattctaaataaaaaaaattatttagtaatgatgtttaatgaaatcttattactttatttctaaaacctagctagtaaaaaattgacactaaaatgaagagaaaaaacatgttttagaaatatgggtttaaaccaatgatttgaataaagcactggggtaagcaagaaagggttttggataagtccaggataacatgacaagtgctaggtaatttggagatggaggaattctaaatcaaactccacctctttataactctctggaggctcagtttctctattgatgcttacagtgaaacagcatcctttaatagctatattgaatttttaaaccattgagtaatttgtagcagctttctatacaagttagtggtctcagctgtcagtggataagacaagttctactagcttctgtcttaaaacataattttagaaatgaaaattctggaaactgtgtttgatgaatgtaaatatagcctagctgaaactctaagacattggaactctgattctccttgaagagaaattgccatttgctacagagaataaaatacatggagattaaaatatgctgtgctggtgattttaaaaagccatcaagagaattaagttaaaaatcaaagatgaaactgatgaaagccagacccctgtctcattgggtactcctctctagggtagttaagatacctggatggccaaaagaaaaagttacataggctatgttcagagaatgtgaaaacagtatttctgaataataggatctttacaatttttatttcattagtgaaagtctttcattatttcccagtattctgctttcatctataattttccctcagatggccacctacattaaataaaacaaatggtactatagtgtcactgactgagaattgtgaagaatttggggatctagagttggaagaactctaatccaatttagtcaacatcagtgtacaaatatgcacattgaattagattatggttgtcctccaggtggtagcatttaacctctgaaggaggggtaaaatgtgattttaaatgttcaagtattctgggacttcttaaaggctgtgagatattgtgaagtttagttatattaataaagatattggtaatgcatttgcaactatgattttgtagaagaaaccttgcagaaaaaaagatactaagtaaaatgtagatatgaagtttagatgcaattacaaaaattgctcatattaaaatattattgtattaataatgcacccttgtaaagcatggttttaaatgttgaagtaaaacaaattactttttatcatatgaaatagtttcatttttaattgattcctttacactgaaataaatacagcaattaaattacacttaaagatatgacataataaaaatatttcttgcctttagtttgatacgtaggtatagatggtttttaaccttttaaatagtgttcacctttctaactcttgctttggcaaatatggaaaatattaggaggaaatgcctttgagaattactattatctagcgtgaattttaggacacggttagtaatagaactgagcatttaattataagatagctggtgatggtaagacacgagaatgaaaaaaataaccattaatataattatttccaaaatatagagatcattaaagtttagaatctattaataagcatttttactcaaacttcaaatcttatattaattaattttgcctttattctagctagaatagtgtaatacagcagaccatttctgaataataaaatgtggcataaatgaggtgctgccacagcacgcattggattaacagaggataatttgggaccctgacatcttaagccaggataacagacgcaggctacatttaccttaagtggagatgaaaacactaatcattatagccatttgctgttaacagatactttacagtatttattgcttttctccaagaatggcttcataacaaacattataaacacgttgcaggcccacgggaaagatttgcagtcaaatgctgtctcacgctaaattagattaacagtttcttactcgtctctaggccaccccccactttgtatatataccagctcatctcatgtccttagcaaataccgtttatttttacactcagaattataatacatatgccaagatcaacaaatagagagaaagtgagccataggttcctccccccagacatatgataagtattaataattgagtacaacactcctttccactgatctttatctgatcttcatgccaaaacctttctcagtgtagtattccaggaagctactaacaagtgatgcaacctcatatgttgaaacctctttgctattgtgggtctatgccagtactttcaagtctctttgactttatagcacatgtaggtcatgaaaaatgtggacaatactttgcattaacagataaggctgcccataactagagatcatgaatctgtgggttagagaccacccagaatgctcatgagatacgatagctcagaacccacttgctgagctctgactgatcaaggtattggcacagtctatccaaaagtagaaacaacactggcagggcaggatctgacatcaagtaaggttttctttattctgtatttgctgtgagtgttattagctgtcaagctgtcttcataattgtaagacagttcacaacatcataaaaaacttattttcccaagccatggattaggtctttggattcaattaatctgatacaggtatgacaaagcattctcttttcaaacagtttatcttagagatacctgcagaatttctattagcatatatttccgtctactctagtgctaatgatcccattatctggctatgtgttactgtaattgaaattagctacagttatatccatcatcttagccctcatagtcacagataaacaatgtggatttatagcaattctaccttggcattgaaaaggtatccctttcagtttctgccttcaggtaaaatgtatactatgtggcttactatttctgatgtgttgattctatacccttttgaaacattttttttttgaaactagtattttggatctgatattaaaattcgttctgacctcaaattcatttgcattacagtgtaatatttcctccgtaatttatgtcatatatgatctagaaggggaggtatgtattaaaataattatctcattcaatgcagataatagctttaaaatatatcgacatgcttttccttataattttttgtattcagcttgagctcccctcccctgacaaagagccacccacttatttcctgaaagaagggggtgggtgggtatattaagattattataacaagaaagcaaagacagatagtttggtttttagattttggttcccaaaacagggcacagtggtcagatgtgggtatattggcttcttcctctgtatggacacactacagaggagagtttggcagtattctcagagcagggaaagtctgacagtagcctggggaaatggaaataatcataaagattccccacattagcctaactctggagcgacaaggtgccacacaggcattaagttaggaacgcctgagaaagacgtcttgaatctgcatttaagggcagactctaaacaaccctattcattacagattgataggaagaaagtagccaagatatttttaccagacccctaagggttgggaaaaccagtaaatcaaaattagtctgggactgatgaaaagaagccacaaaatacagagatctcacagtcataggccatggcaggaacatgaacttcagcaacatatatctgcgtggaggacaaaattttgtaagaggtgcagccgcatttcagtgtgcgctgtcacaggacacgaacagagacacctcactgaactggagaccagtagatattcagagcacattctgcagttcacaggattcttccctaagatactaactttgaaatagagaatatggcaggcctactgaaagcaggaaagagcatcctgataggaaatttgaatgttgtattaaatccgaagtgtcaggtctatgtgaaacaaacaccagataaaaacaaaataagacaaaaactatttcaacttgaataaaacaaatactttaagaaaaaaatcaattgagctataatttacataccaccaaatgtattcattttcagtgtacgattcaatcatttttagtaaatttacagagctgtacagcccttaccaattccgatgatgaggaggggtggaatgggggcagggaaattaacaattaaaagtaactcacttttacaacatttcaatcactttattatacatacgcatacagttatgcatatatacacagattatatttatgaacatttatatatatataaacataatgaacctcttctataaaaaagtgtttatttttcattattttatcaattatttatataattcattcatttaatgatttttatattgagaaatatggagaacacaaagtagaataaaattgtctttctgtttaagaatttcatagcttggtgtgaaagatagtcacgaaaacaaataatgacagtacttgatgaaaagttttatgacagatgtattccctggaattatttcatctctttcatactccttacaaccctatgaaataagccaagcatatgaatatctacattatatagataaagactctgtagaccacagcagttatagtagcaaacatagtgagaggaaaaaacagaagttaattctagattttttgatacttaaaacattcacatatatttggccttaaagacagtagattttctctaccgaaatgtaacccagtttttataaatgttactgaggcatgctttttttttatttttgtggaatttgttattatttttcaacctacaataatctattcaatacccactctgccaaataccgtgctagccatgtggcgcctccaggattagaagttcctttgctgttatcagttcttatagagtgatgttgaattgtaggaatgtgagaatttggcctccttactgataagaaagactattaggaaactttccaacctgttggaggcaaatgagcgttaatgcaaaagttgacttagaaaaagctttattctaattccagcttggccatattctagttgcgtgaatttcagcaatttgctttgtctctctaagccgatttttgctttacaatggggatacaaataccaacctaacaggtgaaaagtaaatgttatataataaaagtgctctttatagtaccttcctcataggaggtacctcttgattatttttaatgaatgcattagtacacctaaatcacctgcatatatttctgaaccctctaagcggtatattgtgccttgattttttaaaaacataataataacctgtaatcctagcactttgggaggcttaggcccagctattcaggaggcttaggtgggaagagcacctgagcccagagaggttgaggctgcagtgagccatgattgcaccactgaactccggccttggtgacagagtgagaccttgtctcaaaaaataaaaatacaagtataaaataatgatgcaatccctgccttctggtagcttacatttgataaattaagctgaaaagaattgtgggtatgcaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaaaaaaaaaaaaaaaaaaaaaaaagaattgtgggtatgaaataggaaacaagcagacaagttacatgagtcacttagaacttgagttcttcttataatatgggttcaaattacctgttgccaggtttaaggtgaatcgtttaccatactgttttattttccatggtctaaactgaaatgtatgcactaaggtcagagaaccaaatattagctttaattacacaatagatatattagagaatgccacagactttttactgttttcctacaagtctaaaccttggcccctacatgtggggataattgggtctgcaatctagttgcttgcataatcctagcttgccttacagtgtagtgagagctccaggtaaagagcacaagtgagcttcaacatttattcattttcccctcgcactggggaaactcgcaccaaggggttagagtcagattcttgccatctaacaaatcagatgaatcactcctgctcacatagggagaagcttgtgagagatagaggaagagcaacaatttctacctacagaaattattttacagcctgccattaggtgtccaaggagagagagagaaagtttcactctacacatctgaggtagaagtttgataagaattaaatgagggtgtatataaaacaccgagaaaactgccgcccctatattacctgctcagtcaaaggtaatatactctgatgtgtacacaatctacatttgcaggaagaatcctgagacccacagcaaatcagcaatgctcctcatgggagaactccaaatcataccccatctctgactcttaggacctttgataagatggttatcttatcaaagataagaaggggaagaaggggttgctgtgggctgtaggaactgtgagggcctcagagaagtcatattttgaactggtgagtcaaaccttgaggagaatgttaacataaagagcttctcctgtctccgtcaagagacataacctctccagtctccgagctaattcaggggcttgaacccatggcctttggtcaacttcgagctctaatatccagaggtggtatttgtattgggttacctgacaatgactggactaacttcctcctccgacacacaccagcaggtgactgggcctccctaaacacctcatgattcttcttccacagcctggcttttgagtaggacttattccacaactgaacagttggaattgcttctgatcatatgtgctgaactgcttagcatttatttaattctcatttcttactgtgtccttaaatctctcgattcttaactagaaaagtggaagtcaagagggagcactactttgattgtctccacccatttcaaaatgtcaggaggtaataaagggggctgtctgaaacctgaggagcttctgtactgtttctgactgagaagtagggatcagagctgagtgtcaggtatgaaattattttcagtctctggcttgctccagcctccaagttctgttcacgtcatgccttctcagactattaacagaaggaaaagctgaggttgtttttattgttctttgttttgtttttttaaaataaagtaaaaacagaatgatcagaacataacactgctgctgaatgcacaaggaaccatcttatcaaaggtcctaagagtcagggatggggtatgatttggagttctcccatgaggagcattgctgatttgctgtgggtctcaggattcttcctgcaaatgtagattgtgtaaacatcagagtattggctgccacagtcagagggaatgtaggcatttcaaagagttttcagtttatgcgtcagcaattgctgaaaactcacccttcaaagtacagatattactaatgccctgtttctgctcttaattgctaattatacaatctgtgtaaatgcaagatatgtgactcctccagctctgcaaatgtctttgcagctgcctgtacactcaaattaaagcccaatgcagctgtcctagaggtagttttatgtgattccctgaatggacaaattctattttgaatgctgttaggagtctctccctgcaccactcaaaagtcacttacattacggttgctttcttcctgttcagcatgtcttctcttcctggatgaagtgagaaattgccattttgctgttccttgctcacttaaatgtgagttacacaagcctttttaaaatttcatttcctctcaggaaatgttttaaaatatataatttatttcttttggtacccatccagaaaagtatatttagctctttttaatgcattgcctatatagaatgtgatttttttcttgagagccttatttcattgagtacaaacctccctttatatttctagcacattaatgttataaaaattagtactttcccgtaccctgaggaatccaggtgtcagcaagtgttaccaaaacttgggcatatgattaattggcttgagcccggatgacacaccctgtggtagcctaacacactcttcaagacgttcatcagttcacggagatattttaatgatcaccactgacatgggaatcttgctccgatgagtcctgtctctgttccctcatagtatcaattcaaatacataacacagcttctctcttggttttcataaaacatgccacaaactctttggaaatgtagtcgagtttattcaaggtttgtgaaggatagagactgaggaaagaatttgcattttcaaagtaccaaaaagcttaatttcagtattagatatctgtattctaaaaacgctcaccaaccacccgtctctggagtatttgcacagacactttccttccatgcagtttctaacatcacaccatcatgccatactggctactttctcttctcttcctcttcccacttctcataccctccatccagtactgcatggagaaatccaaattctttgcctcatgttaggcagatgtgtttgtctctctcagccttgattctcaagcctgcatatccaaacccatacagctacacagacgtgaaaaatgaatttctaagtagaaatagacgggattcatctttttagaggagacttgtaggtacaaagaattatttttctttcactgttatacttgcatcaactgtttgttgtgagttcttttattcattcaacaaatacagctgtcctctcattctctgtatccactgatttcgcatctttggatacaattaaccacaaattgaaaatattttaaaaccccaacaaaatagcaattacaacataaaaattatacagataataaatgatagagtacaataactatttgaatagcatttacgttgtgttagacatcatacgtaatctagagatgattaaagtatacaggagaatgtgtgcaggttatttgcaaatactataccatttcatataagggacttgagcattcctggcttttgatatccacagggatcctagaaacactctcccatggataatgagagatgattgtattcttttaatgcctattatgtagcaaatttcaagttagcacttgttctgggataaatttgtacctgttaataggagacagtataaacatagtagaaggaagccttagacacagaggaacttgattctagttctgattgattcatgctttcactttttctttccaaaaatggttgatgtaacctactctgtttcagcaagatattagatacagggaatgctgaaattatttagagcccctactctcaaacattgtagaatagagtaggaaagacagatgtatatgctggaccgtaaactgagcaatctgacctttatacaaatcaaggttgaatgtgtctttttttttcagagcctgtgtttacttttgactagcgaagagctttcagaaaattaatgttttctcaaatgaaatcgattggcagaaatcagagggatagaggaaatttattcaatgcagagttgacttaaactgcggtgaatgtttactttctggggtcaaaaatgcatgtaccggtttcttttttgttaacatttaatatttcctgttattaataaggaaatgttgcacctgaagtaaattaaatcaagatggaatgtataatttctttgaaaacaataaaattgttattgcagatgttattaaactattagtcaatgtaattttgtcaggattatgtactattgattaggaaataacctgatgaatcatttggaaggatgctttttatttttagctttgactaacaggagtgtttgacagaagcaagttaaaatagtgtgttatactgctacagctatgtgaatttacattaaatgctttatttcagtattttagtatttgctgttaataaagaaaattaggaatctgaactcattttagttggcctttgaacactttgagtttatgagtttgaaaacaacttcaaattaaagatacattgtgatttcactggggaactttgggtctttaaaaattcatctgatggagcatggtgcagttaggccaagtttgcaaagacatatgaatctggatcatatggaccaaaacatttgcttctcaagtaaaatctagctagtcccttttttccatgttacatatgtctgaatttaaattccctatgtcttccatctcgaagataccaggttgttttttttttagctctgaattgtttccacccattatctttttaaagaattcttcgattgtatttcccttttattataaaagcactgttttataacttttacataccaatctgtctccagtaccaatactacctcttttatgaacaacctttgtttagctgtcttattcacatatgtacctatgtgcctttgcatattttcaactctcaataaatgctttttgaatagaattcccatagctaattaaaagtgtcagctgttaaaatggacttcacacttctttctcttgaggtgaacaatgcacactggggtctgagaaggtggtttcttaatctcttactcttagcaggatacccaccttttcttaagtgcattctaagtttctggagatatataggattgcagtccagaagctgtgctgtaactaccaattctccttagatttgagtgaggttaacagagtaaaaacatgatgttttgtgaatgcgccttctgtatatatggcacctttctttatcttcagataggatcagtgttagtagatatgggttttctgtgaagataattaaaagccatataatttcacaggtatatatttggagaggttttaaagaccacatgtccaaatatataagcttttgtttccacaaagtctggatccactccttgtgattagccccattttacagttgagagacattaaaagattatgactgatccagaattccagagcaatatattgagaaaagtagaaatagtaccctgattgacgcttcttagtttctaggagagagaaaattacatgaaccctttacaaaaagaagacagaagataaaattcagaatttatatcaaattatttggctctgagtcaaatttcatctgcaagaatattatgttccaggtgtttgccattgggacaatttaatgtgtttaattagaaaatatattttaaaatattactaggtcgctcagctgtcaaaattatgtaaataaaatggtaagtgaaaataattataaaaatatttaaatgtccttatatggctttttaggaaatgtgcttcattttctttctacacaacccaaatgtccaacagtgatagactggattaagaaaatgtggcacatatacaccatggaatactatgcagccataaaaaatgatgagttcatgtcctttgtagggacatggataaagttggaaaccatcattctcagcaaactatcacaaggacaaaaaaccaaacaccgcatgttctcactcataggtgggaactgaacaatgagaacacgtggacacaggaaggggaatatcacacactggggactgttgtggggttggggaagggaggagggatagcattgggagatatacctaatgctaaatgatgagttgatgggtgcagcacaccaacatggcacatgtatacatatgtaacaaacctgcatgttgtgcacatgtaccctaaaacttaaaagtataataataataaaaaaatacatttttcctgggttcttcgggaatgtgattgttatagttacaaatgtatgcatatttttaaagaaaataaggttgagtttcagcctaggcaaactgctgaacccaaaaatcactgtgagaattttgattagtattctgtagatggttttcagtctatttttgatattttagcttagacttttgaagacagttgagaaagcattttttaacaacgagaaattcattattcctaaattaaaagataaagagtggagagtagatgtatggttgacattttacaaatcaaatactttagagttaataatttctacctgacactctatgtaacacagcattcagttgatggtaatttgttatgtttactgatcactattaagctattaaatgtttttaaaattaattattttattattttctgccatgctaattgcttaaagaagaagagcagtgattggagtggtgaaataaaacaaaataaaacacagacagtttattgtcataatatttctaaattggaagtaagtatagccgaatgcctcttatacaaggagtcagaagatctgcagttgttttcacatttaaaaacctcagcatccttgcacaaatcacgttgcttttctgacttttcaattcttcatctataagaataaatatatattactcttaccttatcttcatagcttttgttaatatcaaatgagtaatggaaatgaataacctatacaattgtaaattaataatgatgtggttgaagacgattcaaggaaattttaacagtctgtgtagtgatccaaatttggctattctaaacaattttctaatatttaaattgtaagccatgcacatttcatgatttaaatatcaatcatatgtccacttactcagctaatatttatttagcacttactgtggaccaggcaccatgcaaagctttaggggctccatggcccacctacaccgcacatgatcatcttctagtggaaagagctggagagtaacatgtgtgactctcatattatctattttgctagaaaagagtatgaacatatatgtatacttttatatcttattgtaatatcctctaactgaaaaatttatccagtagtttcttctctattttgtatacaggtctttggcctcacatatgtaggacatggccccaggagtttaataatcactcaactgagtatgttaattaggaattaagtaattgtattaacaattttttgattgaaactagattgagagcaaaaattatataactatgtgagatcaccaaacacccagagaagtcctgggaataacagtagttcagtaaatgtggaatttgcattttaaaaaggaaacttgtctgaggcaggcggatcacctaaggttgggagttggggaccagcctgaccaacatggggaaaccctgtctctactaaaaatacaaaattagcgaggcatggtggcgcatgcctgtaatcccaggtactcaggaggctgtggcaggagaatcgcttcaatgcaggaggtggaggttgcagtgagccaagattgcaccattgcactccagcctgggcaacaagagcaaaactccgtctcaaaaaaaataaaataaactaaataaaaaggaaacttgtttatataatgaagtacttagaccctgttatttttgccctgatatattttacttaaaggaactttctaaatatatacgtgtgtgtgtgtgtatatatatatatatgtatattatatatattgtatatatatgtatattatatatattgtatatataatgtatattatatatattatatatatatgtatattatatatattgtatatatatgtatattatatatattgtatatatgtatatgtatatatgtatgtgtatatatatacacatatacacatatatgtgtatgtatatatatgtgtgtatatacgtatatatacatatatacaatttttgtatatatacatatatacacatatatatgtgtatgtgtatatatatacacatatatgtgtgtgtatatacacatatatatgtgtgtgtatatatatacacatatatatgtgcgtgtatatatatacacatatatatgtgtgtatatatatatatctcccttttcaaccatattccactatctccaaacagtatgtttaatatagtcacttgttctatcgagatccccactgttttcttgttacagcaatgtacataactctatgtgatatggagcacagaaatttataatgcttgttttcagtaaaagtggagaaagaagccattttagggtatacatagcactaatcacaatgcctaaataacttcataataaataacatataaagaagaatgaaaaggtagaagaaaagaaggaagtgagggaggaagggagggaaagagagaaaggcaaactacagtggtgtgtacagaggttcattaaatgatagaaaggtaaacagtgctccctactaaatcttttcattctagtctcccaaaatattagtgtggcatcagccaatttcatgtctaaaaaactgtctcagtttattactaatcacaccaagaagcaagtgtgttaataatttataatctatcatcgagacaagcttttactgtttctaaattatttaaaatgatctgttttctttgtctgcctgtttatttaatcaatttaattcttatatattgttctatttaaaacttcactagttgacatttagtcatttgctgtcccaagtttgagttgaaggatggaatttttaatgagatcctttcaatcattcaacaaatatttttatcacctatacttctggatacttagcatatagcagtggaataaaacggaggaaaaaaaaaactattattgtcctcattgaagttatttactagtaggagaagtgatatggtttggatctgtgtcactgtgcaaatctcatgtcaaattgtaatacccagtgttggaggtggggcccggtgggggtgattaaataatgggggtggattttgcccttggtgctgttctagtgatagtgagtgagttcttatgagatctggtcatttaaaagtgtgttgcagcttccccctcgtctctctttctcctgctccagtcacgcgaagtggctcactccctttatgccttctaccatgactggaagcttcttgaggcctccccagaatcagaagccacaatgcttcctgtacaacctgcagaaccatgagccaattaaacctcttttctttataaatgacccagtctcaagaatgtctttatagcagtgcaagaatggactaatacagggagatgtacccaacggatgaacgagtgaaatatttaaaatgtcagaagaaaataaatactatgcatacagatgaacaaagtaaggaagatagcctgtgacaatggagtgattttattttaagtagggtggccaaaggacgcttatttgatttaatatttgagtagtgacttgacgaaagtgacaaactgacacatgcaaatatctaaggtaaaaggttacaggtggaggacacaacaatgactaaggctccaaggtgaaaatgtacttggaatattgaggtaagtcaaggagtccagtccagctggagctcagtaagcaaaaaggaaaaggtaggaggtaaagtcaggaagtcagaaaaaaaattatatatatataggttattataaagacattgtcttctactgaatgaaagtggaagccattgaagggtttggaatataggaatgatagaatctgacaggatctgacttttgttttcagagacaaggtctcactgtgtttcccaggctggaatgaagtggtgtgatcataggtcactgtaatcttgaactcctgggctcaagccattctcctgccttggtatcccaaagctctgggattataggtatgagtcaccatgcctggccagatcttactttttaatgtaatgattctgggatttcattcaagatagactaaagggtggtaaagactgaagtaaggagactagtgaagaggctatagcaagacatggtggtgacttacaccagtatcataactgcagaagtaatgagaagaatttcctaacactcattcttgtatatgagacacacacaatgtctcgaagatgacttaaagagttttgccttgaggaaatgaaaaaatgtagttgccatttaataaaatatgtaaaatttcaggaggaataattttctggcattttggaatggaaatcaggagttggtagcagtcatgctaatgtttggatgtttacaatttcataatgtagtctctattaaccttacaagtcctgtggtattgaacataaatttctattatcctttagaagcttcaaagcactaatattttataaccattaaatttttacttgaaacattttggatcaaatttcttattgtttttgtttttctacttttcacatagaactcaaaaaatggacttttaaccttggtagtaatcagagggagtcttgaatttgaagtgatgctaaacacccacacttcatttgcatttatttactgcctttatttttgcaatttttaatttcataaagtgtctcaggacttcctataaaggtgtacgtataaaaatagtctcatataatcacaccttgcagagataactattgttttcattcatattctttcttatcactccataatccattcacaactcacacttgtgtatttattgtgagaatgttatataccaggaactgtactaaatgctttacacggattggctagtttaagtcatacaacagccttttatcagtcatgttattacttgcagataatgaaaacaaaccacgtagtttacacattaaaaaaagtattaaagaatatcaacttaaagatttcccagaaattgcaaatcatgctgaggtgctgtacagatggacaatgtccaagactgcaggacatatttggtctgatagaaaggtcacaattgcttctgcgattcacagacaatgcatgtgacaccaccaattctcctagcactggacactggatattacctctgaaatgtttgcatctgctttccatggacacctatacatgataaattttcttacaatagagtaagtgtgttcaaattctgggaaaccaaaaatactactggaatggtccacgtcttagactgcccaataccagtgtattaatatgtactcagtaatagagactcagataataaaaccaacccctgataagcaggcaaataggaaagcaagactaatttattgtctctgcaaaagagggtcatccaaatagttattatttttatgttgagctgcagctctcatcagcaggtgattgtgattcttctataatttcattacaatttacctcaagggactaaattgggaaggtcaccaccatcaatgaactcctttttaaaaaattactagggaaaagagagaggagaaacacacaaacacacacacacaatagttagcatagccaatcatatacaagaccctgcacagcatccatgctggcaagggtggtggcagttacctccagtattcaaaagcatcaaaaatacatagttattaggttattaaacagaaataccaaaatttatgataagcactgccgaggagtgggttatatttctagctctgaaatctaggatccatctcttacgtgttctgtgtgctggggaaagttgcttaacctcactagccttcagtttcttcatctctaaaatagagacatcaataatatacctatctgatagaactattattgtaataatatgaaataatgcatgtgtcttctattcaaatgtaacttgtttgtgaattaaattacactatgggtacatctgattatctgactggccctgaagaggaccatgtttggctgctcttgcgagtaaatcagtaactcaacagtggcagtagccaaatgagtgataatgaggtgaagtttcaacagcagaggttgcaatactttacgtgttgtatataactcaggattctttcagcaaaagaattgttatgactataaaaactaagaaaacaaatttaaaaatagttttctagtggaaaaatgcaaagatatactttatatctgttttgtttttgtagcatatataatagagaagtagtgtgggaaaggtcacacattgatacagcagaagcattggaataataattatgtctagcaattagcaaacatctatcatagttcagatactatactaagcactttacatatataatttcgtgtaatcaacatagcaatttttgaaaattgtggaattgaatattagagaatataagtaccttgccctaaagtacacaatttaaaatggccatctaacttctatattatcgtggtaaatcaggcacttaatgatcagatatgtaatatctactttctgccatagtgcattcctataaactgcaagacaaagcaaataattgtaaaatgaatggtattttcacaaagaaacaatgccattattgaaaattgtgttcttaaccaataatatgacattgaagacatcatgtatatataatcaagaatatgtcataagaacaaagaaaccgtgaccataaaatgtgctaaatctgatagatattaattaattatgtatttgatgagtaataatgctgcttctcttttttgaacttaggatcttgaggaatattttcagtggcttttatctctaagaaaactctcaagtggggaaaaaaagcaacttcaaagctttcttctttcttgataaatgtcctttacttttgtagtcatttagaactactccactgactatctttttaagttgctatgatagcatctaatattggggaaaaaaagaaaaaaaaaagctttgaatgtagtaatgtagaagacctaatttctaggttcgtctctgctggaaattacctacaacgcccaagcagtagtgcttcttttctgttcctgactttctccatttctacgaagacactagatttggtgaactctaaaggctctttcagggatagaactttctagaaactggtatagagtacccagtccttggatactgatctaagttgttggagagcagacgttttctcagtctggttctgttgactattgattcttatttgtctgttcttaccacaggatcaaatcatgaagggaatctcttccaggttatatgacttgctttggtcataactagtgtttacagacacatagtatgatatgtcatagtaaaataagaaggaatctagaagttttgaattcaaatcctgtttcttcatttactgagtgaccttcaactaagtcacttaacctccttaaacctagaatttcccattaataaaacagaggggatagttcttttcctacagggtaatgataaaaattatgtaaataatgtatgaaaacatcttgtgtgtatctatctccttatgatagttataggctgatgtagaaagtcaaacccacgggcatcttgataatttgttagaaagccactccctaatgggacaatgtgcctagacaaaagagtttggaagtaaggtagagatgctaattagctgtcaactgattttgaactgatcaacataacaaagcttaaatagactctattgctattatcagtgcctgttaattcactcagagtatgtgagcaaactataaacctgcaaaggattacagaggatgcttagcgcagtgaagccctgtactgaatgaacaaataagcccccagggaagcttttaaaaattaccagtttctagagccggtccctggacattatgattcaatagatgaagtgtggtggctaggagtttgcatgttaaagaatcttcgtagaatatcaatgaacagccaagattgagaacacctgaactgatcagattcctcattttacaagtgaggagtatctggcagagggaggaagattgagatcccaaagcaggaacttgaaaaaaagttctcctgatacttaatcctttgttctttccataatatcacatggcaaaagacagatagtagagtcagtggtatttcctgcaagccaggaccattgtatatggtatcctggctgtctatgctgaagtcaggtttatgttctcatgcacataatgtgagccatggagtgctggggccatttgtcagagacaaccttctacaatgtcacattaccaggttgtcaatagtgtacactcacctgaggtaggctgccacattaaaatgggacacaatgacaggggagaatctagatgtaaaattgaaagagtcagaaactgcccacagtcagaggaagaaataagaagtggaagcctggaggcattttctgatattgccttggtgtttgattgtgattctgtttctaggcatagcaaaaggaaacaagactgacttgatggtcaaggtgatgtaagtagatcagctggcttccccaatttttttgaaaccaaaaaagtaggcccggcacggtggctcacgcctgtaatcccagcactttgggaggctgaggcgggcggatcacaaggtcagtagtttgagaccagcctggtcaacatgatgaagccccgtctctactaaaaatgcaaaaaattagctgggcgtggtggcgtgcacctgtagtcccagctactcaggaggctgaggcagaagaattgcttgaacccgggaggcggaggtttcagtgaaccaagatcgagccactgctctccagcctgggcaacagagctagacttcgtctcaaaaaaaaaaaaaaaaaaaaaaaccaaaaaagtaataggtttatatgtatagtaactaacatattataaagttcattaccagaaagtttatatcttggtcaaatatatttacctaaaaagtggaatatgaatattaagatacagtattaataaagtcattaaaactcatgatttgagagaaactagatctgtagttagaggcaacaacagtttattgcatggaaaaatctttccaatttttagttctggttaaaatccttctggggtagcggctttttgtttctaactttaaaaagttcccatacacaatcaattgtactattttattcattttgaaatgtttgacagtggaaggactgggaattgaaagactttgattgcaatcctgacttgccgtggaccaatgtcatgaccttgcagaagttccttttccctagactggtccccattgtactcactggaaagacatgatctcaaagggctcttcaactctaagagtcagtaagagcaaaggtttgggcagagatgaaaataagatagcagggtgcatctgggaggtggaggatggaattgaatctgatcccaatgcatctgtggggatcagagctaaaatcaataatgtatgctgttgtttctttttatctttttttcttttttttctcctaatgtctttccccatcttttcctgcctttttaatattatgtctcctaactctagctttaactcctgaattatattaggattttgttaaagttcatacattttaagcaaagagatgtagaaaattgttaaggcttaaaatgaatttcaacactcagtaattgcatatcctctgcttcctactggaagagaaagaaacttttcgtggactggagggcaggagaatgagaaaaaatgtgttttcttcaaatttctatgaaaatgtgacagcattcatagggagacaaaaaaaataaattagaaaacctgataatccttctggagcagtgctttttctttcatgaaaggcattgtgaatcttcacccatagaaacattttgagcacaattgaatgcatttgtaatttttgaatcctatatttgaaaaacatttgaaagccaaagtactaaaatctaaagaaaatgcttttctatcggcctcctatcatatttttatactgtgatagttacataacttgaaacatggtgtttttaatgtagtattctcaagcaattgtttagggaacaaagactcaccgtatggtacactggaaaatacagcagaaattttgaaatcagaacaaactggactgcaatctccctcccacttcataggtataacaattttggaaaatcactaagctcctagttttcttacttgcttctcgtgaaggtagagtgtaatatttgtacaagctctttatgaacaatacaggttacaagagaaagggaatgtgttgccagccaatcagctcctcaaatgtgctttcattgggtggcaacatctctaatgtgaaattgatattatctatatgtgattactaagatcatgacggaggtgattcttttgaagtatcctcagtgcagggtttggcacagactagttactcaatacatatattctagccttttctttttttgcttacacaacgttaacttatgggtataatagtttaattatcacatgatcacacttgagttgttattcagaataattttgtcctcagcaaataatcagaacattaataggcaatgcagatagagagtttatgagtgaatgacagcaactggcccaacttcttcagcactaggtttctaataattcaagcctgcagattgtgctgtatttttattcatttgcactgcaaagttttttttttctgttaaatccttgttatttggccctgcatcatttcagtaaaataaacttggctccatcaaattcattaggcaagctatgatgtgggaaaagtcaaaatttatcttccctgaagctactttcagacagtaccttaagctgggcattttaaagtggtgtcagataaacttggcagccgtttctttccacagatattcttagttgaagcttttggtctcttcttcactcatgggatggttcctcttgccctggttgcagaatagcgttcgagcagtgaggattctcagcttttctgttttacagccctagagacttggctgctgcagctgggtatcaagcaatgattttcacatgcctttttcatcactttttttctaggagaagattgcttttgacattcatttttaagttacatgtcgttttccaagagtatatctctcacaaaagctttagaatgccagtaataaatgtattagtagctaagaagctcagtctggcaactaccttgtctgctttaagtcagtgtgaaatacttccaataatttaactcttcttaaacaatcacttgatgtaatatttaaatctaaacattaaaatcttctgtggtttttgatctgtattagttcagtactacatagattaaatatttgatatctgtacctgaatttgatctatactcagccagcaggagaaatcgaagggagcattagatactcgtttatttatttattttaatttattctgaaaaatgattaacttacttatttgtcagaattgattgtttaaatgaattgacttgattgtactcattttttggtgttcggttagaataccctcaattgacagagtcactggtccagcagcttacaagtataatcaaaatggctatcttatgtagaaaaggcagtaaaggaatgatattcactgggaggccccttgtgtaggtcaggaactatgttaattattacatcttatttcatttaattcttgcaatgatcttaaaaggtaaatattatcctaattttcaaaggaagcattggaagcagagagtatgagtaacttctgcaacactctagagtcaggattcatacttaagtcagactccagtctacaggaatgggccacaacaccaagctcctcaatgacttgttttgctcttgtcctatcttttgtgcacttacatctttatcactatgttcaaaactaaaatacaattttagtgcttattttatccagttttattttttcaggttaataccagccacagagcaatttagattccccatctccctttgaaaaatatacaattcaataaccatacatgtgcatgtgtctttataatagaatgatttatattcatttgggtatatacccagtaatgggattgcagagtcaaatggtatttctgggtctagatccttgaggaatcgtcatactgttttccacaatggttgaactaatttacactcccaccaacagtgtaaaagtgttcctatttctccattgcctcaccagcatctattgtttcctgacttttgaataatcaccattctgactggcatgagatggtatctcattgtggttttgatttgcattcctctgatcatcagtgatgatgagctttttttcatatgtttgttggctgcataaatgtgttcttctgagaagtgtctgttcatatcctttattcactttttgatgggtttttttttcttgtaaatatgtttaagttccttgtaaattctggatattagacctttgtcagatgggtagattgcaaaaatgttctcccattctgcaggttgcctgttcactccgatgacagtttattttgctgagcagaagctctttagtttaattagattccatttgtcaattttggcttttgttgcaattgcttttggcatttttgtcatgaagtctttgcccgcatctatgtcctgaatggtattgccaagcttttcttctagggtttttatggtttggggttttacattgaagtctttaatttatcttgagttaatttttgtataaggtgtaaggaaggggtttattgcagcactatttacaatagcaaagacatggaaccaacccaaatgcccatcagtgatagattgaataaataaaatgtggtacatatacaccatggaatactatgcatccataaaaaggaatgagatcatgtttttcctgggatgtggatgaagttggaagccatcatccttagcaaactaacacagaaacagaaaaccaaacactgcatgttctcactcataaatgggagttgaacatttagaacatatggacacagagaggggaacaacacacaccaggacctgttggagtgtggagggtgaggggagggaacttagaggatggatcaataggtgcagcaaccatcatggcacacatatatctatataacaaaactgcatgttctgcatgcatatcccatttttttagaagaaatgaagaaaaaataaaataaaaagactttaactcagcttcgtatcctcaaaaaagagaaaaatatgcaattcaaatttccctatgtacaaactaaattcttaaaaaagttaaaattttgtcttaaattacaaattataaatgtaaatcttaaattataaattcttaaaaatacatgtcccccgtagtgagaaagagctgcagttaaaacagtggttagcaattcccagtctagtagtctaacaaatagataccttgtacattcagtgttttattttgcttttcattgtgttaaataatttttactaatattcacagatttcaaatgaggacaatttaaaaatataattagctcagagcagaattccacaaaattagtccttcatgcttgaactgagtgacctgttcatgtactaacaaatatttcagtgtccatctctgaagggcaagatttcaagtctcaaagcttctcacattgcatgtactgagaaactatactcctatgtgattgtcataaaactgaatcctaccaatgaagacgaaatgataagaaattcataagtcctcctcagagacagaaagtacattcccacccttatcacctcccataattgttaaggatgacaattattatagttatatttattgaactcatactatgtgccagtaattgtgctaggtgctttatatacaccctactggctgcctttttaggaggtattagtaaccttatattctttgattcagtaatttcaaatgcggaggcttacaacatttgtcattcaaaaaaaatcactcactgactctaaagtccatgtttttgtcaccatgttgtagctgctccatttaaataaaggtgaaaggagttgagagatgtgtctgctatgtacagcatctgagattaaagaaaagaaaacaacagaacaactaagaagtgtccttacattttttttattcagaatcagaatcaatcagtgatggtttgtaaacatctacagatatgttttgcttcttttgttattacttagggtgttgagagttacagtttatagtatcatgtctttttttttaaagaaaaaaacaattctgtctttggaaaaaaaaaatggaaacctacttatagtttaaaagggtcatttatatcaaagcacatagagccagttcctgagaattttcactgattttgtgtatgacttcccagaaaagccttgtccattccaataggtgacataagaaaaagtgatattctgacattttctatttgctatagatacatgattattaaaataaattcatattgtattcaatttttaaataatttggtaatgtcatttaatgtcagttagttaaatcatataagcttatttgtaactgttccttatattttagaaatgttaatccattattatttgttctttttacttttgagggttttatttaacttttaagttcaggggtacaagtgcaggtttgttacataagtaaacttacgtcatggggggttattgtgcagattatttcatcactcaagtatgaagcctagtacccattagttatttttcctgattctctccctcctgccaccttccaccctccgataggcccgagtgtgtgttgttcctccctatgtgtccatgtattctcattttttcactcccacttataaatgagaacatgcagtatttggttgtctgttcctgcattcgtttgctaaagataatggcccctaactccatccatgttcctgcaaaggacatgatctcattccttttattggctgcatagtattccatggtctatatgtaccacattttatttatccaggctatcattgataggcatttaggttgtttccatgtctttgctcttgtgaataatgctgcaatgaacgtacacatgcatgtgtctttttaatagaataatttatactcctttgagtatatgcccagaaataggattgctgggatgaatgacatttccatctttaagtctttgaagaatcaccacactgtcttccacaatggttgaactaatttacattcccaccaacagtgtataagcattcccttttctctacagtctcaccagcatctgttattttttgaatttttaataatagccattctgactggtttgagatgatgtctcatggtggttttgatttgcatctctccaatgatcagtgatgttgaacttcttttcataggattgtgtgggtcacatgtatgtcttcttttgagaagtgtctgttcatgtccatcacccactttttaatgaggtgggtttttttttcttgtaaatttattaactttcttatagattcaggatattagacctttgctagacgaatagtttgcagatattttctcccattctgtaggttgtcgggttactctattgacagtatccttggctgtggagaagctcttaattttaattagattccatttgtcaatttttgcttttgttgcaataggttttggcatcttcctcatgaaatctttgcccatgcctatatcctgaatgatattgcctaagttgtcttccagggttttttttatagttttgggttttacatttcagtctttaatccatcttgaattaatttttgtataaggtgtaagaaaggggtccagttttagtcttctgcatacacacaatcctttccccattgcttgtttttgtcaagtttgtcaaagatcagatagctgtgggtgtgtggtcttatttctgggttctctattctgttcctttgatctatttgcctgtttttgtacaagtattgtgctgttttggttactgtagctctgtagtgttgtttgaagttgggtagtgtgatgcctccagctttgttttttttgtgtgtgtgtatgtgtgtgtgtgtgtgtgtgtgtgtgtgtgtgttttgcttaggacttctttggctattcaggctccttttcagttccatatgaaatttaaaatagttttctccagttctgtgaagaatatgaatggctgtttaacaagaatgtcattaaatctataaattgctttggatggtatggtcattttaatgatattgattcctcctatctatgagcatggaatatttttccatttgttcgtgtcatttatgatttatttgagcagtgttttgtagttctccttttagagatctttcacctccttagttagctgtattcctaggtattttattctttttgtggcagttgtcaatgtgagttcatacctgacttggctttcagcttgactgttgttagtatacaggaatgctcatggtttttgcacattgatttgtgcatactgagactttgctgaagttgtttatcagcttaagaagtggttgagctgagactacagcattttctacagatagtatcatgtcatttacaaacagtaagagtttgactttctctctttctatttagatgccttttatttctttctcttgcctaattgccctggccagaacttccaatactatgttgaataggagtggtgagaaagggcatccttgtcttttgctggttttcaaggggaacgatttcagcttttgccaattcagtatgatgttggctatgggtttgccatatatggctcttattattttgtggtatgttctttcaataactagtttattgagactttttaacatgaatagatgttgaattttttcaaaagccttttctgcatctattgagctaatcttgtggtttttgtctttagttctgttcatgtgatgaatcacatgtattgattttcatatgatgaaccaaccttgcatcctggcgataaagcctacttgatcgtggtggataagcttttctgatgtgctgctggattctacttgccagtattttgctgaggattttgcattcatgttcatcaaagatatgggcctgaagttttcttttttgttgtatctctggcaggttttggaatcatgatgttgctggtctcatacaatgagttagggaggagtttcttctcaaatttttggaattgtctcagcagaaatggctccagctcttcttggtacagctggtaaagttcagatttcaattcctctgatcctgggcttttttgggttggtagactacttattactgtctcaatttcagaacttgttattgatctgttcagagattcaatttcttcctggttcaatcttgaaagggtgttatttgtccaggaatttatccatttcttccagttttttttttttttttagtttataagtatagaggtgttcataatatcctctggtggttgtttgtatttccgtgaggtcagtggtaatatcccttttgtcatttctgattgtatttgaaccttctttttttttctttatttgtctagctagttatctatctatttcattaattttttttttcaaaaaacaagctcctggattcactgatgttttgaatagttttttgcatctctatctccttcagttcagctctgattttggttacttttttgtcttctgctagctttgggttttgtttgctcttgcttctctagttcttttagttgtgatgttaggttgtttgagatccttttacattttgatgtggacatttaatgctataaatttccctgttaacaccgccttagctgtgtcccagagattctggtatttttttttctttgttctgattgataaattacaaagaacttcttgatttctgccttaatttcattatttcccccaaagtcattcaggagtaggttgttcaatttccatgtaattgtgtggttttgagtgaatttcttagtcttgatttctaatttgattgtgctgtggtctgagagagtagttgttatgattttagttcttttgcatttgctaaggaatgttttgcttctgattatgtgattggtattagagtaagtgccatgtggtgatgagaagaatgaatgtgatatggtttggctgtgtccccatccaaatctcatcttgaattgtagttcccataatctccatgtgtcatgggagggacctagtaggaggtaattgaatcattggggtggttacccccatgctgctcttcttgtgatagtgagtaagttctcacgagatctcatggttttataaggggcttttcctccttttgctcaatgcttctccttgctgcaatgtgaagaaggacatgtttgcttccatttccatcatgattgtaagtttcctgaggcctcctcagccatgctgaactgtgagtcaattaaacctctttcctttttgaattacccagtttcaggtaattctttatagcagcatgaaaccagactaataaaaaatgttatgttgtttcttggtggggcgttccatagataaatatcaagtccatttgatacagggctgagtacagattctgaatatattttgttaattttctgcctcgatgatgtgtctagtattgtcagtggggtgttaaaatctctcactattattgtgtggaagtctaagtctctttgaaggtctctatgaatctgagtgcttctatgttgggtgcatatatatttaggatacttagatcttcatgttgaattgaaacctttaccattgtgtaatgcccttctttgtctttttttatctttattggttttatgtctgttttgttagaaactaggctagcaacttctgttttttttttctgtttttcctgtccttggaaagactggaattttcctccattttttattttgaacctatgtgtgtcttagcatgtgagatgggtctcttgaagacagcatggcaatggatcttggttctttatctagtttgtcattctgtgtcttttaattgggtcatttagcccatttacatttagtattattgttgtcatttgtggattagatcctgtcatcatgatgttagctggttattttgcagacttgtttatgtggttgcttcatagtgtcacttgtctgtgtacttcagtgtgcttttgtagtggctggtaatggtctttcctttcatatttagtgatttcttcaggagctcttgtaaggcagttctggtggtaacaaatttcttcagcatttgcttgcctgaaaaggatcttatttctcctttgattacgaaacttagtttggccagatataaaattctgggttggagattctttctttaagagcattgaattttagcgcccgattccttctggtttatagagcttcagcttagaggtccgctgttagtctgatgtacttccctttgtagatgacatggcctttctgtctggctgcctttaacattttttctttcattttgaccttggagaaccatgtggttatgtgtcttggtgatgatcttttcatagagtatcttactggggttctctgcattgcctgaatttgaatgctgtcccctctagctaggttgggggaaggtttcatggatgatattctgaaatatgttttctaagttggttccattctccccatctatttcaggtacaccagtcatatattcaatttcattacataatctcatatttctcagaggttttgttcattcattttcactattttttctttattcttgtgtgtctgtcttatttcagaaaggaagtcttgagctctgagattcattcttttgctttgtctattctgctattactacttgtggttgcactgtgaaattcttgtagtgtgtttttcagccctatccagtcaattacattcttctctatactggctattttgtctgttggcttctgcaatgtttctttttttattatttgaatgaatatttatttaaagtttccaaaatattaccaagacactgtgctaagctgaaggtggaatatgcaatataaaagcagacatagtccctgtcctcagggagcttaccatctcattggggaaacaatcagtagacaaataaagaaaaataaaattagtgtcttaatagatagcaaagtcaattctttaggaagaaatcatattcttctttaactttctttgtaatgagatatttatttagttatttatttaaattccaatagttttgaaggaacaggtggtgtttcagaaaggtagtgtttaagttctgagtttctttcctccactttgtcttttctgctattactacttgtgattgcattatgaaattcttgtagtgtgtttttcagctctatcaatcaggtcagttacatttttctctatcctgactattttgtctatcagctccagtaatattttatcatgatttttgtcttccttgcattgggttacaatgtactgctttaactcagtaaccttcattcctctccacattctgaattctacttctgtcatttcagccatctcagcctcagcatgttgtaaacacattctttaatccattatcccatgtaactgtaatatttgtttatggttgttagtgtttgttcatgagttttgcaatttgcattgcttaaattctttctatgcagtcaaaactaggtatctctttctgtattaaatttgacttaggtattaggcttaaaatccatttcccatccatttaaaaataaaaccattcatgaatatattctccttgtactttaatggtttaacatttaaattaaatttaataacttttcatcagattataaaaattgatatgtaatcattgtgaaaaattcaaacaacacagaaaattgtaataaagaaagtaaaaggagccaaaaatagtagcattaaaaatttttgatatgttgaaaatgtcttttcagatgtatccttagtcatatatacaccatgtctgaggatgcaggtgtgtgtgttgttctaaatgctctatgcacactgctattgacactccaaaatatgtcgtggtgcctttttatgtcaattaatacaaatatttttcattaccaccaacggttacatggtgcaccattttatggacttgttacaatacatttcattaaccatctgtttccagttttttattatttagacagttatttgataagatcatttgtttgcatatgtgtgtgcatgtatacctcacccaattgtcaggttaatccatttttatatatttctagactttgaatttttgacctaaaaagattgcaatttaaaatggttttacgtatatttctaaaagattgctataaatattgagaaatgtttacttctaacatctgcttaatctttacaaatttgatacttaaaaacttatacatctcattaaaaatatatctgaatgtcagagaagttagcacacatacacccaagtataacattttattaaatcctcaatttaattttccaagcataagaagtttttacctgaagtgaaatggcaacacaaggtaagaacagatgtagcatgttttgatgtattttttcttttggcgccatgcagttgcagttatactttctggacaaatttgcatcttgcttgatttgtgaagttccgcactttctttcccgctactcttttatactcagagctagtaattttattgtgaaagaacagagcaaagcagtgtatcctagaccatttcagggcatgtgtgcatggttttaaaactaaaattagtatcagaaaagctacattctcattcaggtggtggtaagggagggattgaataatttgaatgtgtcaatagaggatcctgatatcattaaacagtatctgcctctatctttccggtatttctagataaaaataaacaaagagagtattccatgaaaaaaaaacaacaaagatatgagaaaaatcatgaaacagtagagagaatattggtatctacgaaagttgtcatcccaacaaatatggttgtacacaaccaaatgctatggctctatgaacttcattgctgcagtggtataaaatataagccaagaagctttaagaaatgaggattagaaaagcttatgctctattttaaaagatttgactttattcaacatgtaacgggaaaccattagataattttaacccatgaagtaatacatgcatgtttgaatttcagaaaactccgatatttttgtggagactggattagagaagtactcacataaagaaaaagtagagagtgaagagtctgttgaaataacactggcaaaaattaatgtttgaatgaagaaaataaacttttaagaggcaaaattggtaggactttgtaaaagatgttataaataaagaagggaaaaagtgtcaaagattactggttcatatgctgaataggaaacatcggatttaatgcaagttttacttttatcaagaatatattataaaatggtaagttcaagagtattgaagatgtgtacaaacggtgattattatcattcaaagtcaaatttaagatagacaaggaggaaagaaaacatatcaaatacatgatagtcaaaagataaaaatatttatggtcctggtgggagcaaaggatgttggaattgtagttctagaggaactgagccagaaagataggaaatggcgatcagagggtgggttacttgccattgagattacctagcatttgcagttattggtagttattttcagatatgagtgggagtgagtggctgaagtgggatggaaggcataatcattggaagagagaaagttcaggaactgagaacccctggtgttgagataattttccatatgaatgttaaaatcgctgaggatcaagacaggaatagggactacagagcgcagagttgcacagaacatagttctgaattagcgaaaattctaatggtattaaaaactttaagaggtaatcatggtattgtttcttagagattcccagtgtgatcatacaacctatatcatcacttttaaaaatattcccagtccatagcctataataagggcaagtttacacatgcaccatataatgatatcaatccctcatcacaaacgaatggaatacagatggacacctgaccattatattctcatcagaccactcaaatactcttcactagaaactttaattggggtccagtgactgggtcagtcattagtaggaaatttagttcaagagtcatgtagagtcatgggctgaggctccaattctggggtatctctgattagtcatgtgtgtttgctgagagttaaggagaaaaggcttttctgagagagaagcaggagaatggagcagcaaacagacataaacacacacatacacacacacagaaaaattgtcttgattctaaattctcatgaggtcatgttacatttcctatcactaaattctgtaaattctcatgtatccttaccatacttctaatatttagctatgctattttgatgggattcctcctccatgcaatcagatttgctttatgagagcagctataatttactcattcattcaataagcattaaatgagcacttactaagggcctggactgttggaagcactatggaagataaaaacacgagcaaaatatggtttctgtcagtcagaaaattaatagtggagaaaacaaatataaaatataattaaaacacaatgtaatgagtgctaaactagagatgagcggtaaatattatgatctcattaggcaaaaatacaatatgttagctaatctgaaagatctggtagagtcagaaaaagccggtagagtcaggtcaaatgagacaaaatttaaaagtgtcttgagcaataagcacatatttgcaaagtgaagatgtttgaatgtctagatggagaagtgaaggtaacttagaacaagagctttgaataattccaagattcaagggtgtgttagtctgttttgccttggccataaagactattactggagactgggcaatttataaagagaaaagttttttttggctcaagattctgcaggctgtaggagcgtgacaccagcatctacttctggtgaagcctcaggaaacttataaccgtgaagaaaggcaaagggagagtaggcatgtcacatgatgaaaaaagagcaagagagagatgggggaggtctcagactctttttaacaagtatatctcacattcactcattacttcaggagggcgccaagccatttgccagggatcttcccccatggcatgacccaaattcctcccattagtccccacctcagacatttcaagatgggatttggaggggacaaacgtccaaactatattagagggttaggtagattggataagttagcaaaggaaatgtgaaagaaaaggcaaagggaagaaactaggggactgtgatgtcatacaaactcagggcaaagagtatttcaaggaggtagatgtcaattacattggacattactgtgacattaagaaatacaatttttgaaggtttacattacattggtgatactggtttccttagctggaggaagtaaacttagttggagaagtttcagtacagcagtgagagcaaaatctggttgaaacaccttagtagtatgtgggaagtaagggattggagagagttaatatggacaattaattttttaaaatggctttgaaggtcaacagagcagtagccgaagagagaagtaaaatcacaggataatttttttaaagatgtaaatatttgagtgcattaaaatggagctaaagattctatcatatgtcagtgggtagagaaagaataattaaatgatcttgtgacaattagtaaaaggttatagaaatagtaatgaaatgatgttgtgacaattagcaaaaggttatgcacagagatgttaagcttggctttatttacaacagcccagaaagaaatgagccttaatgtcacaaaatgtcccaaaataaatgacgaaaatcttgaagatttttcataggatttgggtaggttattatgaagaatttaaaaataatatttcacagtaacattaatgagaaaaattatagtggccaaaaattaatcaagtgaaaaataaaaagtacagtgtaatatataaagcatattaactatgattcttattttgccattcacatacgcacaaacactggacaaagactggaataaaagaaaagaaattgttaagcagctatctgggtagtaagattactggtgattttactttaaaaaaactcaacttttaactttcaataataagcatgtattatttttataatcagaaagaaacaagtattgttctatactagatgagttaagcatgttacatatttctctagtagacaaaaatcctatgcttctaagaatgagacttattttcccatcaatttattatatcattatcatcaccaccatctctcttcttaaaatttatctcctacctcacccagactgcataatccaaatatttaaaaactctgaacatgaactactaggcttttcaaaatgtatgtgtagtgtgtgcgtgcacgttcacatttaaatgatggcaaaaatgtgtttcagggtctttttttaactcaaacaatttcacacctactttaatttttcaatcctgcattcagaagctaatatatttagaataaattctaatgaagccatggaaactatttaatgttatgtcaattattggtgattgtgtgggcaacaatgcagcctgtgtggctgattggaaattatttctcttttataaaaaagaaatcttgaagggttccaacttgctacgattaacgatacaagtaagcttaatttataactccaataagagcaaagaaagatattttttcaatgtggactggaaaaactgtgaaaatcatgataccaagatgttaccttcccattgtattcttaaagatttcagtttcttatttttgaaataatttgaggtgaaaatacccagtattaacattgaaagtagtaagcttttctgaagtgtcttattgtttgcaagtctttaactgaacttagagcctcaatgtgaacactatcagggtcacgtgttgtccctagcaccatctggtcacacagagaagtcctttagaactactgtagccttgggattggaaacacatgctgtgttctacctgaaagtgttagctttcattgtgaattacccatacatatctctgaaatccaagatggttatttatggtgggtgactctgaaatgaaccagatcagcaatctaatatgacagcgtatctcccaatgaagatgatgacagcccaggattttctggatttatttagtatagaaatgagacagagagagagagaaagagagagaactcaggatggtctttcacaaaatagattaagaacaaactatttacttgattgtgctgtttgagtcaatcattgaatagaaagatcagaaaatttaaatttaaaaatcagcacattcataacacataaaccaaatgagttagggaaactgaaaagcccacctacttaacttctccctaatattctttaagagcatgaacattttcgcatttcaaagaaaaacaaagaaacgaaactagcaaaagacaatataaaattagtacttgaaaccattacaacagaataacaagtctaataaagatggcacaacaagtgtccagtttaactaaccacttgtgtcccaagcatatggaaatgactgataaactatcagaaggaaagacaaacaaaaacatagcaaattcaaaagcaatataatttctctctgaaccaaaaggacaacagagaaacacagtgttaaagtgggctgaaggtgcagctgcgctaggctgtttgtaagcggacaaatggaacaaggacttgtgctcctgtgtagtattaggaacttagcatcctctataaagacaggttaccaaagcaaagttctttgctagaaatcagaccctgaattatcacttcccatcttctttagctgggaaaatgtttgggaccatgaaattttaaagaactcaggaactaggaaattgaaaatataaagataggatctatgaccagaaatctttgttatccatttgatggccctgtgattttctcttgtttatgattaataaatggcatcgtaagaaaaactagagtctgcatggcacttaaggggtttggtggataaaattatacaaacaagcaacgggagtttattcaagataaattttctgtttgtgtgtgtgtgtgtgtgtgtgtgacagaaagagagagaggaagaaaatgagaaagaaaaaattctccctttaaagataagcctgtacatgagaattctaaaacataatgagaaatttcatgctaagaacttaggcaaacaaaataatcagtattacgaatatatatttattacaaattaaatcaatttaaagaaacaatatgtaaagactatgaaactgatacgtttaaacaaaggaaaattacaaatcaatatccacaatgtcattttctgccatttatctacaaagaccaataatactattttgaagaacaaagtatggggacttgtcctattatatatcaacatttatccaaaaatggcaattaagacagagtggtcttgttgaaatgattacaaacggacaagtagaacagacatcctagaaactggtatatttatgtgtgaaaactgaaaatatgaaatagatggcaattcaaatatgagggggaaagtataaatgataccggaaaattggttattcgtgtaaaaaaataaaattagattgtgcatcacagcagatcaaaactaaatccaggtggataaaagaactggatgtgaaaatcaaaattgcaacacttttagaatactatatagaaaactggctcaatgactacaagatgggaaagtatgcattacaaatgatgaaacaatgacagtatgaagaaaataattctatcactggcttaggttgtaataaaaaatatttggtaacattaccataaacgaagtggaatgaaaagtggaatcttggggaaattttatttgaaaaaatgaatagcttaaaaaagattaatatatagaattggtaaatagctacgaataaaaataatggttagtttatggatagtatacccataaaatgggaaactctgcagctgttaaataataaagcagatctatattttttgataaggaaatatatctatgaaatgttattaatgaaatcaagcaagatttagaacagtgtgtatagtatgctacctttgaatatgtgtatttgaaaagcacatacattttctgtactcagtaggttacaagatgcaacaggaacgaaactattcttaggaaaggaatttggctaaaaaataaaaggtaagacaataccaggggctagaaatggggtacttcatacactgccaatgtaaacttaaattgacataaacagggagcaatttcatagtttctaattaagttgaatatgtgcatgttgtttgatccattagtttcactctaaggcatacacctggaacagtggttctcagagtgagctggggacccttggggaggtccttgagatgcttgtagatggtcaggaaaggacaagttagatttatattattactaagatattatttgcctttttcaccatattgacttgtgtactaatggagtaaaatcaatgactaaaactgatagcacattaacatgaatcaagatggagtaacaaaacatactagtaaacatcttatttttcatgatcacatattcacagtggaaaataaaagacaagaagaaaaaagcaagttttatttaacaatatctttaacgaaacaaaaaaattagtaactgcactaaatcttaaaccttgagaatgtatctttaaaaaatattattggtgacaaaatgggaggtacacacaaagtacttctactttataccaaagtagataatgtcttaaggaaatgcacttctgtgattgagttccaaattgaactagctgcttttattcatggactgccattttaattgaaaagataaatgacaaaccattgttttctacttactagtttttccttctatttttagttgacatataatacttggatatatttttgggatactgagtggcactttgatacatgtatacaatgtgtaatgatcaaatcagggtaattaacattttcatcacttcaaacatttgtaatttctttgtggtgggacatttaaaatcctcttttctagctttttgaaaatacacaataaattactgttaaccatattgacactacagtgctatagagcactagaaattattcctcctatctagctgcaattttgtatcccttaaccaacctctcttttattcctcctcctcattaccctcccagtccctaataactactattttattatctatttttatgagctcagagctgtttttcaactccgacatgtgagtgaaaacatgtgctatttgtctttctgtgtctgtctcatttcatttagcacaatgtcctccaggcttaacccatgtggttgcaaataacaggatttcattcatttttatgcccaaatagtatttcattatgtatacatactggattttctttatgcattaacctgctgatggatattgcatatcttggctattgtaaatagtgcttcaatacacatgggggtgtgggtatccctttgatatatggattttttaaaaatgtatacccaatagtggaattgctggatcatgtggtagttttatttttagttttttgagaaacgtccatactgttttcaataatgacttaataatttacattcccaccaacagtatacgagggttatcttttttccacatattcaccagcctttgtggtttttttgtctttttgatgatagtaattttaactgggacgagatgatatctcattgtggtattaatttacgttcactaatgattagtgctgctgtacattttttcatatacctttggccacttgtatttttttgaaaaatatctattcagactctttgcctattttgtaatgagaattttgttttattttgttccataatgttgtgttttgttttttgtttgtttgtttgttttgcttttgagttgagttccttgtatactctggatatcagttccttgctggatatatagtttgtaaatatagtccctcattcttcagattgtctctttactctgttgattgtttcttttgctgtgcagaagctttttagcttaatgtagcctcatttgtctatttttgtttgtgttgcccaagcttttgaagtctttcctatagcatctttgcctacaataatgtcgtggagctttccctctatgttttcttctagtagttttacagtttcaggtcttacattaaagtattttatgtattttgagttgatttgtgttcattcttctgcatatgagtatccagttttcccatcatcgttggttgagtaagttgttctttttctaatatataatcttgaagcctcctccaaaagttagttggcttcaaatacatggatttatttctgggttctctgttttattcaattggtctatgttttctgtttcaatacgaatttcatggtgttttgtctactatagctttgtcaaactattgttatttagacaagcttttggcagacattttctgagaaatgaagggagtgtaccacttcaaggaaaacaaatgagagtgtttgttgccaatgatcttacttgaaaattcaagcaaaaatgggaatttttcaaaaatttttatctaccatgcaatcttgaccgtttcctaatacttaaagacttttctgatgagtttggcaatgaaatccataaatataactttttatattgtataaatgaaaagatctgcgtttggaaggtctacatactttagggaaccaccgttttctaaatcaccaattcaagatgttacaaattagtcatcagtaaaaatccaaagcacaagaaaaacaaatggagtttaacgtaaataagtatacaacttttcattgatttggtttcagattctacattgcaaataacctttaagaaactaccacctattgagttttggtgtaatatcaaagaatatccataattacccaaaaaggttattaagacactgctgtcttttcttacctcatttctgcctggggctggattttactgatatactgcaaagaagatgtttcactccagattggattaggaaaattcagatggcatttttttttttttttttggtcagaaatcaaagatattttccaaaatataaaatgatgtcacatttctcactacatgtcttattttataattataattatttttcctaagtgtcatttattttaatatgtaattggtttattattatatttaaattagttaaaacataaatatattaacactttttagttttaattcttaaaactaaatactgatacatataacccacataaacaaaagaaaggctctttgaggtccacaataatttttaagagtgtaaactggtcctgagaccaaaacattttagaactgctgctctagagaaaatattttcaattgttgtaaaatatacgtaacacaaaatttaccatcttatttcaagtttatagttcggtagtgttcagtatattcacattgttgtataacctacataaattcataaacaggaacacaaaaaaatgaaaaagatattcaatgaagcatcatttataacatcgtttataattgtatttagattgtttatgtgggaagcaatgtatctatcaagagaaaaaagttaattttatattaatatctataaattctattgtgtgtttatacaatgcaattatatttttccattgaaatgaacaaattaaatctacatatatcaacatcgagaaatttcaaaattataatgccatgcaagaaagcaagctactgaataaagtgtataggtgaatataatttatcaaaatatgtaatgtatgtaaagcttgaaaatatgcaaacagtgttgaatattgattattgacacatacacaggaagtagtaatatatagatgtgtgtaggaatgatttatacttattcagaaaaatgattacttctggaagggcatggagggagatgaattcaggcagggccacactggggctttaactgtatctataatatcttttccaaaaaagaaaagtagaaaataactgaatataattaaccaatgttaattaaccaaaattaaccactctgtcacccaggctggagtgcagtggtgcaatcatggctcactgcagcctcaacctctcgagttcaaccaatcctcccacctcagcctactgagcacctgagaccactggcacccgccagcacggcggttttttaatttttatttttttgtagagacaggatctctcaatgttgcccaggctggtctggaactcctggcctcaagaaatcctcctgccttggcctcctaaagtgctagaattataggcatgaaccactgtgcccagctagaattttccaaagatggaaagctgggtagtagtaaaaatatgttctccatgtatccaaaatactattctatatatccccagtgagagagattgacagcaaataaaagtatcctcctttccttcattcagttgacaaatattccttgagcacaggggatacaattgtgagctaaaatgcatttcctgatctcaaggggctgacattccaacagaacaacctatatagacccaggcattgttcttatgttaatgtatttaaagatgatctttattttgagaggaatgggaagtagttttaaatggttttgaatttcatcagactcttttgatcactgggctgaattgtcgccctgggactgagtccctaccttttccttatcacacaattaaataaaaaggtagagacattaattcatcagatatttattgagtgcttgctatgttccgcacgctgttctatgtaaatatagatacagcagtgaacaagacaaagttcctctcttaatggagcttgtaatcaagtttgacatcatataaaattcaactatgcatttatttattcaataaatatttattgaataatcattatgtgccagatactgttttagaaactgagaatctaagagtgaacaagacagactaagttttttttttcttttctttaggatatttccctcaaggggagacatacaataaaaagacaccaaaaaatagatacttggtaaacaagtatacaaggtaacatatagtcgtaagtattatgaagataacagaacagggtgatggttgtgagattgatgggtaagagttgagaaaccctttctaatgagatattttcacagcaataggaaatgcatgagcaaatgagccgtggatttctggcagagaagaggaaatgcaaatgcttctaggaggagcatgcttagtgcatttgaggagcagcatggaagccagtgtgactgtcactgagtaaccaagcagagcgcttggagctcagatcagtgtggtaggaaagagctagatcatggaggagactgtctcaaagaagaatatctctgtaaatgtctgtgacacagttgtatgctataaatattgcaatgaactttcttcatttagccattcaaaggcccttgcccctgaccttttggtcacattgagtggttaatggggttataatcccagaaagtgaaagtagaatggggtaaaaaattcctctttggttgggctttcactcttagacactgttacagtaaatgagagagagccaggacacaagaggtgcactcagctccataggccaggtcaccacacaacctggaagagagttcaaccctgatatttgtttataatcacctagttgcacaaaatgtaaacctgtccatgaccattagctcctccctgtgcctcaaataatggggttaaaagaatggactcagaactagagtgtctatactattagtgagaggaggggccagctggacttcctgggtcaagtaggggctcagaaagctgtgaaactcactcatttcctgcatcagggcttccttcggtcctggatggataatattgaagatatatgcttaaaatattcctaacaccaggatttgtgcatgtgttttcttccccaagaaagctataaacactgaaaattttgctctaagtttccctgtgtcctttctccctctctcccttccccctcctccgagactaaagtaaaaggaatattaactgcccgtttttctgtgaccagcagaccttatctatgctcccaattccaattccttgtaaacatactttgtaaagtcctgtgagatcttgtcttttttgccatgccactgaaaggtcataaaatagatgaaacctaagttgcaattccggttttcctcaagatctaaaacatgtcacaagtggttaattgtctgtgtttctcgctctggtaacatcttcccactgcacgtatttcctgccttaaagagtttaaaaggcaatcgtataatctaactctggctacccgttcgggaccccttccacactgtggaagctttgttgtgtcactctgctcaataaagcctacagctttttctctctctcggtccttgtctccatcactcgccgcggtccgccaccacaccaattctttggcgtggctaggcaagaaccttaagcgttacattaggttggtgcaaaagtaattgtggttttttcctgttaaaggtaatggattaataggattctgaattcatctttctgagctgtgtggcattagacaaatggcttcatttctctacagctcattctccttactgataaaatggggctaataatcaaatgtttgccatagggctgctgtgagagttaaatgtaataattcatgtaaaatcttagactcatacatgccccatagtgttttaaaatactggccatcatcatcgttattgatattattatattttaatgacaattattgtgtgctttttttttttttgtggagatggagtttttctcttgttgcccaggctagagtgcaatggcacaatctcggctcaccgcaaactccgcctcctgggttcaaattattcgcctgcgtcagcctccccggtagctgggatttcaggcgtgtgccaccacaccctgctaattttgtatttttagtagagacggggtttctccatgttggtcaggctggtctcgaactcccgacctcaggtgatccacccgccttagcctcccaaagtgctgggattacatgtgtgagccaccgcacccggtggcaattattgttaacccaatatccattagattaattcatctttcatgtgatgtatgaatttcctaaatctgcttgttgggtatctgccctcaactttattcaattcctgacattccagctaatgtggtctttttaaagctttatgataatgtacatgctcttgcttaaaagccatgttttcacagggagtggtggcttatgcctgtaatcccagaactttgagaggccaaggtgggcagattgcctgagtccaggagttcaagaccagcctggaaaatatggcgaaacctcttctctactaaaaacacaaaacattagctggatgtggtggcatgtgcctgtaatctcagctactcaggaggctgaggtgggagaatcacctgagcccagtaggtctagactgtagtaagcagagactgcaccactgcacttttagcctgggcaaccagagtgagactgtctgaaaaaaaaaaagaaaataaaaaaagcaatgtctccactgcccttatgatataaagatcaacttcttaacatgactttcaatgtgtgtcatgatctgttcgtggttttctaatttcacttctcatcactattttccttggatggttagtgtcagcctctcttaactgtgttcaatattctaggtgcatgatgctcatctgtcttggcctagagaagttgttcttaaactatgatctatggaccagccacatcactatcagcaccaccaaggaactcataagaaatgcaaattattaggctccacccccaacctattgaatcagaaattatgggggcgggttctggtatatgttctttacgaaaaccagcagatgattctgttgcacaatcaagtttgagaactgctggcctagatatctttttccaaggtcctcaagattttgcttgaagaacgtacaagaaattttcaagatttatcgtagatcttacctcttactctctaagaaagctccttgcattcaccttccattttatttgttcatctttccctttagactatgatggtttggaaagcatagaagtgtcttcataaaatttgcatacccaaaatatagcatagtaccttaatgtatcatatgtggttcaataaattatgtagcaataagtgaaagaataaataaataaatgaacagatagtatgagaaaatattatcttaacagtgggcactattagggagagaaccatgtttaggaaaatgttttcacatgccacttatgggtcaaaagtgacatcctgaaggcatgaattacaagggaatggaaaaaacagttaaattgctctgcataagaggtgaacaagaatatctgaagttggataaataaaggatgagataaccaaaagagagaggttagcaaatatgacagaaagatgaagaattttagagaaaagttttgagtgagaaaagtccagtgaggctttgaagaatagatacatagaatgttcatgtctgggtttgtgatattgcaataagagatgtcctctgttggtcatcaagtatacattaaagtataatgaggctgtattcaacatagcttgtgtggccatgttgcggagattactgtggcacaccatacaagaaactatgtgctgccctacagtaacctctctgtgatgtctctagagataacctaattgtcaggaagaaggcagtggtccagaagtcccaggcagtggagccgaggaaggtgcaagaagctgcttccacctgaaaataattcaatcatagatatatcttttttcttgttattcttgtcattgttgctgctgcatctctcaaatatactagatgggggccatcttagtaggtggaggacaggtaatatcagtgttacatatttgataactttaaattatattcacaaattctctgataggcttcctttcaagaagtgaagctgaactcattttcagtatgagctagacttagtgacttgcttccagcaatgagaatatggtggaagtgatgagatgtcacttccagtgggtacagaaggactgtgacttccttcttgctgttctccagcaccccctcacaatcaactctcttcctttgccctctatccagtatccagtgaggaactgaggccacataagtgggcttggaaatgagtcccttaaccccagtgatgccttcagatgattgaagcactgaccagcagcttgacttgcaagatcatgagagactctgagctgtaaccactcagctaagtagcttttggatttctgacccatagaaacagtgatgtagcaagcatttgttttttaagcttcaaagatgtaaataatgtgttacacagcaatagataacggatacccatatggttatcctatcttatgaggaataaactgaaatctcaagaggtcaatgggtttgtcccatgaacaaaaagctataaattcttagagctgccattcaaaccctagccttgtaactcctaattcattagtcctaccattatatcagactgccatcagtcatgtgtaacttatttattatattcccaaacctagaatataattctaagggcattattaaatcttaatcagaaatatcaaaatatgaaggtccatggtttaatcattgtctttgtatatcctaaccaagaacatgcgtaccaactccaaaactgcaaaaactaattattagaacaagaaagtagcaagggactttcgagatatctgtaataaagtttcactatgtagacagagagaacccctgagagaggaaattactggaaaatgccacagcttgagtaagagatggaacaaagactcacctcaactgtacaaagaaaacgtttttgaaatttagttttaatgtagttagttccttgaggacagagacttacaagttgatgtgctcaaagcttggcacaatggctggaacagaatgtcaagacactcttttgagacagagtctcgccctgtaccctggctggagtgcaatggtgcgatcttggctcactgaaacctccgcctccaagcgagtctcctgcttcagcctcccaagtagctgggattacagatgtgtgccaccacacctggctaacttttgtatctttagtagagatggggtttcaccatgttggccaggctggtctcaaactcctgactttgtgatccgcccgcctcagcctcccaaagttctgggattacaggcacgagccaccgcaccaggcccaaaacactcttatctagcctcttgctagattaataatgcactctattacttctgtaaaatatagtgatgaatgctctaaggcatactgaaaactcacagctaattgcctacccacttgtatacatctgcttccacctgttgagttgtatgctcaccaacagcctttatgttcatttccaaatcactttatgccaaatgtacaaattattataataacttgatttgattgaaaattatagaaactaattaaatataagtttaaaatgagaagtattctttttatgaaacctcaaactattggaaaagatttgataaaggaaatttgttaattaaaaaatttttactatttttaattttttttatacaattagatatgggagagagtttagaaaaaataaaacaaaaatctagaagcattctgcttaaggggtgtcctcaagtttctgctacatttcatagaaggtgaaacttaatattagagatgatgccttatcatgtggtttacaatgataagcttagtcaaaggacccacacacatttaaaaggccatgagaaagaaaaatgaggccaacacagagaaacataaatgtttgtttatattatgtaaaatacatacgttatctaagataagtatatgtaatttgtaaatgattttcagcttcagccaatgttttcaattaatcaactaagtattggtcacaattagataataaggcttctgctgtaatgtatatgaagtgtgtaataaatgaattaatgccaactctgatgaagtagataaaacaaggcaccctacagatgtaaggcatttttcagtttatttggaaacttgtcaatactcatctaatttacaccgaaatttcaaccttgtttttcatcgttgtgtaattagaagacatctgaacaaaaataaagaacttccaagtctttgtttgtttcatgttgcacttatctccctccttggcagggtaggtttctttctttgggtgttttgtgaaatttatcccttggcagctctagttgattggcttacatactgggtgagagtttgtaagcagagtagtgtttccagtgccatctacaatgtgatggtggtttctgacaagagtttccagtgctgctaagcaaccattactgatggctaaaaatagggaacaactatcatatttatgggactctgaaagcttaaggagcttttacaagccaattgctttggtacataattactataagattcagcttttgaaacggattaaaatatattgtgtgtgaatctgcaataattttctacagccaaaactgttcctcagattaaaggctttgtttgcattgatttcttttctatttaaaaatattaatcgtacttcatctgggtagacattttcttcccgtgtccttatttccctgaattaaagagatgcaataatatataaacaatacaaatatggagggtagatttgaaacttccttctgaaggaactgttgatttcttcacacttgtgtctttatatattaccattttatcatgaatccgtttacctctgcattatttcatatttgcattcattaacattaattacttatagttaccattttttatctctttatcaaccatccctcttttcatctgtgcatttatttattgacctagctgccctgcaagcgtccatcttcatcaactctttatctatttgtctagtatcatataatgtcttctctttattttgaagttgtacttaaaaccattgcaaaacttgcatcactatccctttctgactccttacatataaaaaaatgacttgtagcacctaacacgccccacaaataacacatctaatttcaagctccatgagggcagaggacatatatctctttgtgctcacattgtgtctccaatcctagtacagtgagtgactggcctttaatagttgcccaatacatattcattaaatgaatgcataaatatctcccatgtgtttatatccttatccatttctcactctttttgaccatcgctccatcagtttctttctcatcatcatccttttattacctactttcacttctacaagcctgtctgtcaggtttttcactcatcatcccaactattcatctatccatttctatacctaaagctccctatctgtatctaagcagctatctaacattttgttaatatattacaagatatttttatttgttcataattgcatctatgcctctttcatctccttgtcattcattaatccatcattctccaccatgcttttaacctaagttatattgcgtatcgttttaatatcgaatgataaggtctgcacagtttccagtgaaaggtccaaaggaaggatgacagagagtttgcacctttctccatttattttatacgaattcaattatacaaattcagcaaataaaaataaaaaagaagagaaaaaaacagcaacttaagtagtgcctgtcacttcatttaatgaatgtagccaataaatgaaacatgatatatcgattcctaaagtcctcctaatgagattacaaagtttaagaacacgtattcatacaaaacgcccttgcaacacaagccgactatttttttgtgtagctcacccagaaaaacagcaatttgttccaaatttttagttaaaaatagctatgtcggttctgctaaccaacagtagtatgcttaagaccacactcctatctctacacattcaaagtcacagccacctaactgcatatagtagaatatttttagccatttcaaatattttagctatttcaaatggctttttcttttttataagccacaattgattttaccatctcaaatttttctgagctaacaatcattttaatcattttatctagtctctcagtttctttcataatgcagaatcttccattctggatcccctgtcctcacactgtcagctggactgttctgtaggactcttaaatggctgcaatgctgaaatttcccttattgctttattggattctatgtcttcatcttcctggctttgcatttttcctagaggatattctcaaaaaacatcttgaaatacatgaaatgagcgaaatgaacatgttcaagaccttcctgcttgaaacttttttttttttttttttttttttttgtttgagacggagtctcgctctgtcgtctgtcgcccaggctggagtgcagtggcgcgatctcggctcactgcaagctccgcctcctgggttcacgccattctcctgcctcagcctcccgagtagctgggactacaggcgccccgccacaatgcccggctaattttctgtatttttagtagagacagggtttcaccatgttagccaggatggtctcgatctcctgacctcgtgatccacccccccacagcctcccaaagtgctgggattacaggcatgagccaccgcgcccggccgaaaagttctttattttcacctttacatttgatagtttagggagcaaaaactttctcacatccgtgcattttcttctcaaagtttgaagcatttcttcattggtttctcgcattcagcataattgatgaaaagtttgatgtcagaactacacattcttttgtacgtaactgactgcttatcaacaactccagtcctagctcccaggaacactttgtttttgtattttctttgctgttataaaattttacaattatatagaaaagaaaggttatcaattttcatttattgttctgggtattttgatatgaaaagttgtgtcctctttgggaaagtctcttctattatttactgaatatgttttactcatagattctgtattctccctttatagaatgcccaataatcatatattaaaactacgaaacaaagactaattttatatttttccacatttttaatcttttttatgagatttatttaaatttaatttcaagtttttatattaaaaattttgttggtgattttaaatttcaaagacatttttctttttccatagttgtgtgtttcttcctcctttttttttttggattcactctctggaaacttactatagtttttttattcttttaattttgtttctttcgtctggactgatttgctttttgttttttcttattttctttctgtacatgtttttcttagatgtgtggtgatatttctttgttcatattttagaatgaagcagcaaaaacctactagagactgttgtttacatggttggagatttcaaatgatgggttttagtttatcataaaaaagagtagaagcttgaatgtatgttctggaactactaaattgcagaacacccattaatttgctatgagccgaaaatatccaaacaataacctctgttttctttaactaattttatttctctagtgaataattttaattttttttcaagcagttaaatacattactactaggattgttccacttctggtgttacaaggtgagaatcttcttagacctgtgacccagtgaaattgttgaaaattatacatatattttatatatatgttgtatttattatatatgtacgtgtgtgtgcacgcacgtgcgtgtgtgtctacatttaagtctcaggaaatggtactaaatgtatatagcaaattaagaaacctttattccaaaaatctattaaaattcttcaagaacagtgagagtctgtggttattgaaccaagaaccattctctttttcctctgtcagagctcagtgagccagaaactccattccagactgatgcagccaaaaatggaggaattcttctgcctccagcttttagtcacgggactaccctcccaggaagcatgggcaggatgttgacattcctcatccagtccccagctacctgttgctaaattctgggtgagtgaaactaagaaataggagcttcctttttcttcccagctcacgcttgtgagactaaggctctaccttgggtgaaacactgccaagaatattgcgtcactgattagccttttcctctcttgcaggatggcaacttcatgctgggagaggcaagcagaagatctgagtcttctcctggaactgagcacccagtcttaaactgggagtgtcgctcagggataagtgtgacgttgtccccattttcaactccaaagccatggctcaaggatttttcttgggaagaggaggctataaacagagtgctccaaatatcgtcccaaagaaattgatttaatttgcaacagagtgtggaaaagttcaaatctaaaagtgttactgtggactgaatttagtcccacccaaatttacaagatgaagctctaacccccaacgtgatggcacttggagatggagcctttgagagatacttaggtttagacaaggtcactgggggggggctctcattatgagatttataagaagagacacaggagcttatctgctttctctctctctctctctttctgccagccacatgaagacacagcaaaaaagcaatcatctccaagccagaaagagaacctttccagaaacgtatcatgctggcctcttgacattatatataacagaaatgtattgcacagttttggtgactgggaagtccaagatagaggcacaggcagatttgttctctggtgaagacccacttcctggttcatagatggcagttctatgccgtaccttcgtataatggatgtggacaaaagaactcttgggacctcttttataaagtcattcatcccattcatgaagattccactctcatgacctaatcacatcccataggccccagctcttaataacatcacattggatattggattttaacatatgaattttgggggggagtcacaaccattgtctatagcaccaacttcagataattgttaaaaatcacttcttcattgtggttttcttccccttgtgtttattgttgtgcatttttgtcatttaggaggctataaaaacagcttgtttgctggagctttgcacatcattgcttcattcaaaagagaatctcagaaaattactgtgatgtctataatctaacaaagagaatcatggatgcactaagtatatactgtgaatttaactcagatgctcatgaacaaatggtttctttatacttgtatatcagctcctctatattaaagatgtagctaattaaacatatgtttattttttatgattattttagacatttttcttcttgagttttgcttgttctttgttgctaaccaaattgtttgaaaattcttaggaaaattacttatacctacaaattacgtatgatgtctaatttaaactctaaacagactctatttctcatgttacatagtggagaaggtataactccatatggttaattgttattttgaacctgaagtcttaa

SEQ ID NO: 1204 - DNA, 1023511 bp, Homo sapiens
tgagtcagttgaattgtaaattgatgtgattttttgtcgtctcattaaaagtaaatgtccttttgatgatggtgactcactgtataaagattagacactttttattaaaacaagcattttggaaaacattttgcaaataattacatttaaagtttctgaaatttggaagtgttcatttctgtttgaaaattgtttttcatttattttattgctttgatgggcaaagtcttgtaccagctatttttaagacattcaaagacttagaatgcacagattttatttactttctcatttgtttccatctaggaactgagtaatggctccatggttaggatcactgttcctgaaattgccacctctgagttaggtacgattgagaagtttcatttataagacatgaagtaattgtgatttacattaataattggggttttaaacattattttgccatttttgaagccactggatcaagttcttagctttgtagaggagccttaaagagctagggagtgctttgtgatgtccactctatgtgtgctctaaggctggagtacaggtgaaggatgtgctatttctgttctctgaggttcttctgttggggaatattgtgcagtataataatatatggacatgcctgctgggcatggtggctcactcctgtaatcccaacattttgtgagactgaggcaggtggatcgcttgaggtcggtagttcgagaccagcccggccaacgtggtgaaaccctttctctactaaaaatacaaaaatcagcggggtgtggtggtgcacttctgtaatctcagctacttgggagtctgaggcaagagaatcgcttgaacccagaatgcggaggttgcagtgagccgagatcgtgccactgcgctccagcctaggtgatagagtgagactcagtctcaaaaaaaaaaaaaatatatatatatatatatatatgtatatatatatatgtatatgtatatatatatgtatatatatatatgtatatgtatatatatatatgtatatgtatatatatggacatgcctcttgcaagaacatctgggaaactggaagcctaagcgactaagataattcttggcatatttaatgtttttttctgtaatgtattaatgatgtttttaattttaaaatgaatatctcaattttcagataaattgtgaaagtaacctaattgccttaattgaataaaacttaatattattgtcaaaatacaatcagaattatcttaataaatattggattctgcttgaattattcctgagatgcaatttcaaaaatgctagaggagaatatttctgaacatagcatagtaaacaaaatgttagaattgaagggatttgccaacaaacgtaggttaagaaaagaatgcctgtatgatataaggaagttcatgacatatcttggtttccaatctaactgccaaagcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccacttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttgggatgtgaagaggaaggtttgatttgagggagatttaaagtgctttagcctgagtatctactctgttaatggtagaaagccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatccttttttttttttttttttttgagacagaatgtcgctctgtcgcccaggctggagtgcaatggcacaatctcagctcactacaggctctgcctcctgggttcatgccattttcctgcctcagcctcccgagtagccgggactacaggtgcccgccaccacgcccggctaattttttgtatttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggttgcgttcgtcacgcctctgcgtagaatcccccagtgacttcccatgtcactcagagtaaaggccataggcctataagatgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactatatgttttacttattttgttttgtatccctcctcccccaactggaatgtaaattctaggaaggcaaagatttttgcttagttttgtttactactctctctctccaggacctgtggtattgcctggcatagaaggatactcagtgaacatttgttgagtgaatgccgttttccatctgagtgaggtactgtttttaagagtttgtgtctatttcagcacatgaaggaattgctgtctgcaatttcctttagaaaaatcttatgggaaaatagggacaattttcttttcttttctttccttttttaagacggggtttcactctgtcgtctagggtggaatgcagtggcgctatcctggctcactacagcctctgcctcctaagttgaagcgattcttgtgcctcagcctcctgagtagctgggattacaggcatgcacctccacgcctggctaatttctgtatttttagtagagacagggttttgccacgtgggctatgctggtttcaaactcctgagctcaagtgatcctcccaccttggcctcccaaagtgctaggattaccttcttttcttattttaaacaattgtatccaagtgacattatccccaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctagggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaggtgatccgcccgcctccgcctcccaaagtgttgggattacaggcgtgagccacggcgcccggcgggcaagacaccctcagagcacagggtgctgccaagagcccggccgagtgcagctggagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacctcgcctcggtgcagggctccgccccgtcgcctggaaaggtgagtggatctcgaagagaccgacggcctcgacctggcggggcggtggcctcgacctggccgggcggcggcggcggcctcggcctcggcctggccgggcggcggcggcggcggcggcggcggcggcggcggcggcctcggcctcggccccggcctggccgggcggcggcggcggcggcggcggcggcggcctcggccccggcctggccgggcggcggcggcggcggcggcggcggcggcctcggcctcggcctggccggacggcggcggcggcctcggcctggccgggcggcggcggcggcctcggcctggccgggcggcggcggcggcggcggcctcggcctcggccttggcctcggccgggcggcggcggcggcggcggcggcggcggcggcggcctcggcctggccgggcggcggcggcggcggcggcggcggcggcggcctcgacctggccgggcggcggcggcggcggcggcggcggcctcgacctggccgggcggcggcggcggcggcggcggcggcggcggcggcggcggcggcggcggcggcggcctcggcctcggcctggccgggctgcggcggcggcggcggcggcggcggcggcggcctcggcctggccgggcggcggcggcggcggcggcggcggcggcctcggcctcggcctcggccttggcctcgacctggccgggcggcggcggcggcggcggcctcgacctggccgggcggcggcggcggcggcggcggcctcgacctggccgggcggcggcggcggcggcggcggcggcctcgacctggccgggcggcggcggcggcggcggcggcggcggcggcctcgacctggccgggcggcggcggcggcggcctccacctggacgggcggcggcggcggcggcggcggcggcggcggcggcctcgacctggccgggcggcggcggcggcggcggcggcggcggcggcggcggcctcgacctggccgggcggcggcggaggcggcggcctcgacctggccgggcggcggcggcggcggcggcctggcctaaggtacttctgttggggaatattgtgcagtataataatatatggacatgcctgctgggcatggtggctcacacctgtaatcccaacattttgtgagactgaggcaggtggatcgcttgaggtcggtcgttcgagaccagcctggccaacgtggtgaaaccctttctctactgaaaatacaaaaatcagcggggtgtggtggtgcacttctgtaatctcagctacttgggagtctgaggcaggagaattgcttgaacccagaatgcggaggttgcggtgagccaagatcgtgccactgcactccagcctaggtgatagagttagggttagggttagggttaggcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccgcttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttaggatgtgaagaggaaggtttgatttgagggagatttaaagtactttagccgagtactataccatctactctgtacttataccatctactctgttaatggtataaggccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatcttttttttttttttttttttttttgagacagaatgttgctctgtcacctaggctggagtgcaatggcgcaatctcagctcactacaggctctgcctcctgggttcatgccattttcctgcctcagcctcccgagtagccgggactacaggcgcccgccaccacgcccggctaattttttgtgtttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggtagcgttcgtcacgcctctgcgtagaatcccccagtgacttcccatgtcactcagagtaaaggccataggcttataaggtgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactgtatgttttacttattttgttttgtgtccctcctcccccaactggaatgtaaattctaggaaggcaaagatttttgcttagttttgtttactactctctctctccaggacctgtggtattgcctggcatagaaggatactcagtgaacatttgttgagtgaatgccattttccatctgagtgagatactgtttttaagagtttgtgtctatttcagcacatgaaggaattgctgtctgcaatttccttgagaaaaatcttatgggaaaatagggacaattttcttttcttttctttccttttttaagacggggttttgctctgtcgtctaggctggaatgcagtggcgttatcctggctcattacaacctctgcctcctaagttgaagcgattcttgtgcctcagcctcctgagtagctgggattacaggcatgcacctccacgcctggctaatttctgtatttttagtagagacggggttttgccatgtgggctatgctggtttcaaactcctgagctcaagtgatcctcccaccttggcctcccaaagtgctaggattacaggtgtgaaccatggctcctggccttcttttctaattttaaacaattgtatccaagtgacattatcctcaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttttgagacggagtatcgttcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaagtgaccttcctgaccttggtgtcccaaagtgctgggattacaggcatgagccactgcacctggcctccatggtgttattcttaagtggtccaaatatgtttttttaaattgtggtgtaatttacaaaaatgaaatacatcttgagtttacagtttgatcagttttaatatatgcacactcatgtaacctacactcctatatagacacagaatatttttataactccataaaatttccttgtgcggttttttttttttgagacggagtctcgccttatcgcctaggctggagtgcagtggcacgatgttggctcaccacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatattgttacagatacccgtagtttgtgcttttttattgctgagtagtatgaatataccatagtttgtttatccatccttcttctgctggtagatatctaggctatttccattttttttttttaagtcatgaataaagcaagctactgccaaaattcactggcaagtctttgtggatatatattttctttttttgggggagggggacagagtcttgctgtgtcatccaggctggagtgcagtggcacgatctcggctcactgcaacctctgactcccaagttcaggcagttctcatgcctcagcctccccagtagctagaattacaggtatgcgccaccatgcctggctaatttttgtatttttagtagagactggattttgccatgttggccagcctggtctcaaactcctggcctcaataatccgcccatgttgacctcccaaagtgctgagattacaggtgtgagccaccatgcccggcccgtggacatacattttcatttcttttttaagagacggggtgtcactttttgcctacgccggactgcagtgatgctatcgtagttggctgtaatctcgaactcataggctcaagccatcctcctacctcagcctccaagtggctaggactaccggtatgctccatcatgcctggctaatttttaaatttttttggcagagacaaggtcttactataatatgttgcccaggctggtctcaaactcctgggctcaagcagtcctcctgcccctatctcccaaagtgctgcgattacaggcatgaattttaatttcttttaatttaatttaatttcttttaaattaaaattcacatctgtaattttaatttcttttaatttaatttcttttaaatgaaaattcacgcctgtaatcacagcactttgaggggtaggggcaggaggactgcttcagcccaggagaccagcctgggcaacatattatatagtaagaccagttgtctaccaaaaaaatttgaaaattagccaggcatgatggcgcataacctgtagtcctagctacttggaggctgaggttggaggatgttaaacactctttcatgtgctcattagctgcttatgtatctttttgtgaagtttctgttcaaatctttatcaacttgtaaattagattttaaaaaatttgtaagctggtgaagttcttacatgttctagacatgagttcttgaccatattttcccttagaatgtggctttaacagtgtctttgatgagcagaattttttattttagttatccaatgtatcagttttttattttattttattttatttttgagatggagtcttgctctgttgcccaggctgtagtgcagtggcatgatctcagctcactgcaagctccacctcccaggttcacaccattctcctgcctcagcctcccgagtagctgggattacaggcacccgccaccacacctggctaattttttgtatttttagtagagaccacgtttcaccatgttggacaggctggtcttgaactcctaacctcaagtgatccaccagccttggcctcccaaagttttgggattacaggcatgagccactgtgcccagccaaggatattctttttataacattttcaaaaattaaggcatattgtatatacaggaaaaaaaatgaagcctatgatttatatttacaattgctttgatttaatacaaattaaaatattactgtttatgagaatgagattctaaatgtaaatggaattcacagaatgcataatttttttctcgtttaaagaaatagagtctcgctgtatgcctaggctggtctcgaactcctgggctccagccatcctcccatttcagcctcccagagtgttgggattacaggcgtgagccaccacgcctggccttgtacatgttatatagtgaccattttgcacaagattgtttgccaaatgaataattaaaaaaatccatttagtgtactttcctttaaatattttcacacctggagttaaaacattgtattttataaaatgttattaatataaaaatacttgtaaataaacttgtggctatgtagaatgtagtagaggacttttgcataagcccagagcctagtttctaaaggtctttagaaatatataatagacatagaggggaaagagttgggggaaatcagagggaggtataattctggtctctcgtcgttcagttctttttcattcagttctctcaggcacgactccagccacttagttttatatttcaactggatgttgacccaattaaaacaattcacagctcctgaagatgaaatactatgagtccctgctttggacacatctgtagtagagtaggaaaagataaatataacccaagtaattgttacagaatcttctgaaatatacaaatggtaaaaggttttgtagggcgtgtactggggaaaaagataatttttcaacatgaaccttttaagagcttgtgagtctcaaagagtctttaattgataggtgatatggataatactcccctttgggaggaggtttataatacataaacaacctccccacccttccctcacagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagtattacaaggttcagtgaattgtctgagatctcacaaatacaacctagataagaacccaggtattattattttcagtcttgcaatattattttcctacttgcaatattatcttcactcttcattaagtttgcacagcaaagtaatggaataagttctgggctttaatccttgagtagtttggaactgtaatgtgttacatttgagagagagcccttcattttgaataaaaccttggtactgttcctgatcttctaacttgggttaatgctcttcccattttcatgatttttttcatttgtgaaatgaagtagttgcactagatcattttcaattttccttcccacttaaatcagttttaattaaaaaaattgcagatgccttttctcagattggagtacactttttgctccacacaatatctggtgtgtaaattggtatgttccgtggagtaaatacctttcctgactagccattaacttacttctgattcctgaatccactaatttaactattgttgaaattactaaaggaaatttttctttagcaaatgtaaaaactcatatcaggtctcaggtttgatgttgtaaagcactctgactcttaggaagactctttttttcccccaacctctcataaacaaattatttcattcattataaaatttcattcattacattttcattcttcagacttgcagtgtttcctctctgctaagtatagtgttaaacactggcaaaagaactctggacacaacatcatgaacttgctctctgggatcttataatctagttgcagaagcagattggtaaatacatagtatagcacaagtactataatggaggcctgaactgagtgctgtgggggtacacagatgaaggcttctgggagacatcatggcataactagacctggaggatgaataaaactttggccaagtaaatacagagatacatgaaaagcatggataaatggcacaagtaggttcagggatgataaaagtgttagtatgtggagagtgtacaactattttggggaatggggaaacagattaaatttggggccagaccccgaaggatgtggggatcccatcaaagtcttttaagcaggagaatgatcagatgcattttttggtatactacctgggggataggaggaagtggactacagaaggggagatcagtagaaggaagacaagttaggaagcttttcagtcattttcattaaacatgaagcttaatacatattgttctaagatcaggaatacagcaataaagaaaaaaacttgctgtaatgaaacttacattttcttgggagagacagaaaataaacatgaaaaacagatgtgttcaatggtgataaagcagaaagggagatggggagtcaagtgcatgtggggagggtgtttagggaagcacttatgaaagagtaacatttgagcaaagagccctgatacaagacaacaatccagacccaagacatttgaggaaagagcatccatataaagggagtgggaggtagagaaaacctggaccaggaatgagcctggtatgattgaggaaaacacaagggatgtggccagagaataataagagaataaattagaggggtaataggcaattgtatagggccttgtgagccattgtgtggaccttggatttcactcttgagtgacctgggagctaatgggggattaaacagaggagggacaggatcctctatggtatatggtaaatgagtagtatggtaaatgaggtaaatgaatagtaaaaggaactgctgtggtaatttaggtaacagatgatgatggtttaggtgaaagtggttggattgtggatatggtttgattggtgttagaaccaataggatttagtggtggctggatgtggacaatgggagaatagaatgaaccaaagctattgtaaacgtctagaaatcagatgaggacttgacgaaaggcattggcaatgagaaagtagacaggcaccattcatgaggtatttcttagcattgatagagttggatataaatatctggaattcttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacgctccacagtcttatcgttcatagtttcttggcaaactcaccactcaagctgtgcctcacttatttaggagatctgcctcactagggtagacattttaggtttatgactcttaagttttcacctggacagattggctaacaaaaagaacctcacaggtgggtgaccttgaattcaccaggtcatgccatcagttcagagcggccggagaactctgttctcttgtgcattgatgcccccggagttgtgaaacacagtggccctgcttcagttttttagatttagaaactggtcagtgtcagagcgatcagacacagaaatgttaattcatgttcaaaaataataaccaggctagcatttgtttagcacttgctatgtgacaagtactgttttaagtgctttacatgaattgtttaatcctcacaacaaccctgggaaataggtcctattattaggcgccctttctacagatgaggaaacagacaacagattggtaaatttcccaagatcacaaagtaagtcagtaggagctcaaagtaacctgactccagagcccacactctttttttttttttttttttttttttttagctggttcacgtctctttaatgagatcaaaggctcctgtgtatgtcttgcgggggtaaagctagcacagtcccccaatactgcccctctcctcagggctccagccctttcaggcagattctaggtaggcagggaggggccaaaaggaacgcaaggagttgggactagggctgtttctggtgggcaagtaacccatccaccctctcaaaactacttatgggatgtccccttcactggaagacagccccatgggaaagacctgcggtacagaatctgggggcagtgcacacggggagtagtcctccagatctggcagggtggcactaaccctcacctccttgactggctcagcctcaccggaggcaggacaagggcagagcttaataccggagtcgccagttaaacggcgatagcggcaggaggggggtgtgggggcaggggtcacccctgccccagactcaccctcctgatgagggagggcactctggtgggaggaaacaccttccacatttgttccttcaaaatgggcagggcagctggatgaggaggaacagcaggtttgttcactggaagcagtcaaggggcggcctggggcgacagtataaggcgcggaggcggggggcggggggtggtgcctgggcggtgaaccacatcctcgtaggctgggggcttgaaggtgctgaggaggcgaaggtcaagcagtgaaccggtagggaaaggaccagccccatggcatgccccatgataagccaacaagttgatttcacgctgccgctgctgttgttgcagcctgagtttagctcgtcggtggcggaaggcccaacagcagctaaagaggatgaggacagtccagagcagccagaaccaccagagctcatagtagtaggtgcagcagccagtctccccgcagcagtgaacactctcacagaggtagggctggttgttcactcctgggcacagctctcgaagctgctgttgcggcgcccgaagtgccccccaggcctcctcgctgccgttcccgctgctggcccgagccatacctccacctacagccccctgaggaccacagcctcctctaccgccagccgccccgcccctgccacctctgctgccactgccatggtccctgcccggcccatcttcgctgaggccaccatcactccgcggccggagcttccatccccagagcccacattcttatctgagcatatacatccccatcacaagagaacgccagtttattcaagtaaaataaggactagaaatttacatcagggaatgtattctttcactgtagaatgctgaatggaaaaccaaatttcaatagttgcctactgaacaagatcatgagataacaacaagggagttgattataaatgactagaagttttaaatggcatcgactctgataaagtgataatctcagctccatgatatactcgtcaagcagttacttacatcaatctgccttataggatatcctttctcctggttaatgcttatgtgatagtgttttgtacctttcctttttcactgctttcattactgaccaaactactcacccccatatttctggtagatatatttcttttcattgcatgttagtatcttaaatttagtcctatcttttacttgatcctccgtgcttgacttcctaatctatgttctggtttatgttttagttttacagttgagctttctgaggacattcttattcccagtatctttttttgggtggttgggttctgggaggtggtatttgactgctgctgatgtgtaccaaccaagacagtagtcattaagtgactaacaataatgatttcagcagattattactcttggcaaagagcaagctttctctattataaatgattttatatttgttttgtttttctttatttgtaatttgagttctagcttaacattattacttcagataactgttaatacattttcataaatcatacattcttgaatggcaaataaataaataatcaagttccaagtagtttctaaagagagtaaacattaaaagtaaacataaaactacataaaaatcgatcacagtctattcataaagttggtatgaaaataaagatcctagatttggaaccctcatgatactcaatattttacatatatcagagtttgtaatttccataacttcatttggtagttagacatatagacagagaagataataatatattcattatatatatatttatgtattatattcattatatatatatttatatataatattcatattatatatatatgtctataacatatagacagagaagataataatatattcattttatagtttaggaaacagacttggaagggcaaataacttgtctaagatgactaagcagctgagtgagaaccacagcctatctgtggcattcagtttcagccatctttcccttgcttcataaggatagttactctggtatcagttgctggattgggattttgggcatttataaatgtttttattttggatattactgaatcacagacaatttcatcttagttaattaaaaattcatcttacgtgacacttgtctaaatcttaaaatattaaaattttaatgtataaggatgttaataatctttatattttaagagactatgaagtcaagtctagctaacttagatctgtaagtttttagctatggaaagcaattctattgtgtacaagtttcagcctgtgaagggaattcattgaaaatgtatagagatcagaagaactaacacctttcttgcatggatttttcttgattattggcagttaacaataaaatgttattagatcactggtgcttctgtgtggggttgagttttttatgatatcttctgttagacccataagggaggctgtgagttgttttctacatccttggaatatataagatcctcttttaaaattatattttatataagcacatgaaaatggaatgaaataatgaattgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatatacgtgtatgtatataaatatgtatacacatatataatatctggagcaaaaatgattatgttgtaagaacttttggaggttttcctcctcgtaaaattccgaagtggtagagttaacattctgcttttaatttatctacaaaaacatgtgaagaatccccaaataagattttctcatagaagattcatggattttgagtctcagaaaaaaaaggaagaaaaaaacttcatggtataaaacaactaaaaattaaatatagtctttagaaatgattttgtttagtataaataatactggtatgacaactgaatgcaattgaaattatgatataaaatttctattctgctttgtatttttcattaaagtttttataattgtcatctgaaaaaggatttaatattcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctaaaattggaaaatgaatattcagatactaagagtaaattttttttttttttttgagacggcatctaactctgtcacccaggctggagtgcagcggtgggatcttggctcactgtaacctctgcctcccgggttcaaattattcccctgcctcagcctcctgagtagctgggactacaggcccacaatgccatgcccggctaatttttgtattttttggtagagacggggtctcaccatgttggccaggctggtctcaaactcccaatctcaagggatctgctggcctcagtctcccaaagtgctggaattacaggcgtgagccactgcacctatatgacatacttgaaaaaatattcttgggccgggtgtggtggctcacgcctgtaatctcagcactgtggaaggtcgagggtggatcacctgaggtcagtagttcaagaccagcctggctaacatggtgaaaccccatctctactaaaaatacaaaaattagctgggtgtggtcgcatgcgcctgtaatcccagctacttggcaggctgaggcaggagaactgcttgaatccaggaggcgaaggctgcagtgagcagattgcaccactgcactccagcctgggagacagagcgagtctctgtctcaaaaaaaaaaaaaaaattctcactttctgttgttgttgtttgtttaatgattaatagacgatttatttaagcaagaatacatagtcatcattgccagacttaatatgacaggttaaatgttggacccaattttccttcccagataagtttttctttcctatccctgtcagttttgaaaacataataccagaagaagaggggcccaattccacacagagctcccaagagtgagtttttaggagtgggtctgaaattaggaaagacacttgctgatcttgcataggtccaaggaatcaaggcaggattttcgatgagccctcggcagttagggtaagcaggtttcagccaggctcttaatggtcaaccacttggcttgcgcctgctgggtttccgaagacatgtcctattcggctggtttgagggcatagtggccaggggtgaaggagtatactttgggaacgacatcttggcgacccagtgcacaactcacttttttttggaaacgaggttggctctgtcgtccagactggagtgcagtggcgcaatctcggcgcactgcaacctccgcctcccgagttcgggcgattgtcctgcctcagcctcccaagtagctgggactacgggcgcacaccaccacgcccggctaaattttgcatttttggtagagacggggttttgccatgttgcccaggctagttttgagctcctgggctcaagcgatctgcccgctttggccttccaaagtgctgggcttacaggcatgacactctgcctggccagatttttgttaccctgtttagatatgatggtaactgaatgatcatgcaatctctgaccatgtgacattcagggataccaaaaatgacttgagatgggccaaggcagaattggagaagcatactttggctgaatacttaggccaaagtataatttggaacatttcttttaaaaaatctactcccctatgcctcccagttgcagtaccttacaattacagttaatctagtagcagatacttgattgggatattaggtatttacagaccaaatgcccattgggatattactcggtaacaggcagtttcactctggttcattgtagattcatccagtaagcatttctagagaactgctatatgaaaatattgtggaaagtatcaactttttaaacttttgatgtcatgacacctagaagattattttctgatactcatattctaagggaattttattttctgagatttgtttctgtggaatttttagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggtaagctaattctgtttggtttattcatgcaatagtctgtctctgcttatgacataaagtataatatattttaggaatagtgtggttttcttcatgatgtcaaacatacaagcttatggatatatttaaaaattcttaattttctagattaatgttcagcactacttcttccatcttgcattggatgggggcagataattaataattatcagatattttcttatcaaaaacaaatttgttggaaaaaaaattttttttttttgagatggagtctcgttctatcacccaggctggaggtgcagtggcgcaatctcggctcactgcaagctccacctcccgggttcacgctgttgtcctgcctcagcctcccacgtagctaggactacaggcgcatgccaccatgcccagctaatttttttgtatttttagtagagacggggtttcactgtgttagccaggatgctctagatctcctgacctcatgatctgcctgccttggcctcccaaagtgcggggattacaggcatgagccaccgcaccaggcctcaataaaatattttataaatacctttaaggaataatacaaacacaaccagagcttaaataaataaatgtaaatcaatctgcttgctggttaagtaatgagttcagtgtttccgcacagaaagtgggagagatagatgaagaagaaaataaagcttattacatgttgggaaggattctaggcactaagttcctttttttgagacagagtctcattctgtcgcccaggccggactgcagtggctccatcttagctcactgcaacctttgcctcccaggttcaagagattctcctgcctcagcctcccaagtagttgggactacaggcacctgccaccatgcctggctaatttttgtatttttagtagagatacgggttcaccattttgaccaggttggtctcgaactcctgacctgaagcgatctgcccaccttggcctccgaagtgctgcgattacaggcgtgagccactgtgcttggccagttctaggcattaagttataattggttcatttggggactcgaaattctccattttattttattttattttattttttctgcttttgtcacaaaagcacagacattgcttaacaaagaggtctgagacaggatatgaatgttaagctcagggacatagggtcaacacttttgagtgcacagactgggaacctggcagagttttaacaatcccctcccctattttcaccatcccttagtcctgtagaagtagagcagatgattacgtattcactgctgtatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgagacaagaataaccagaatgatgataaggagacactggaagtcactttagattgatgaccaaagatttccttattctgaccaggaggtcagatctcaagggtccttctgagtccacttttgattagccaaattgtcttttctttcagtttgactataggttagtcaaccttccctccacattcatcagggactgttagcaatatgtcatatttttttcttggtgtaccattaagcaatctaaagctatgctgttacctgtaaccacttggattaattattttagattagttggttatacttctagggctttatggctttatcttttcagtcagcattattaaccaagttttgatagctttttcaacttttgtaacccccatccagggagatcagtgtcctctcagacacttccaggtaagcatgatctcctggaagacatgagaagtctcttaaattgtctaattattacattggagctacataataactccaatatacctggagttattatgtgtatatgcaagttaggttctaatgaggcaaatataagtaaatatgttgttgattcaggaggtaaaaattaggagagccacgtgtagttttaaaaacaaaagaggaattacttgtaacagaagtaagtaagaaaggaattctcagttatctcttgggtagagataccttgcatagagttcagcaaaaattgcaaaggttgtcataggactatggaggccattaggctaattaaaatttataatattgcccatatatttgtactaagtctcattcctgaaggattttatatttgggttgaggctttgagaaattctaagactggcttgggcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttggagactattgatactcatcagattttaccactgataatttttcaagaggaactgtttatgaaactataaagagaaaatggagatacaaaaagccatccaagatgtaaatgccgaaggccaagttttgagataaacagaaaatcacaaaaactcatgtcaggtggttcttccatggccccagtgtgagcagacagtattttccttgaggagaaatactagtttggtgggggtaaggtagggagttaaactttaaggattaatcaagagaactatacatatgctatttaggttgagggtaaagatcagagtaggcatgggcaacgcctagactcaatcaagttacctatcaagcaagctgacatattcagacaaagcaagactccatctcaaaaaaaaaaaaaaataaataaataaaaagaattccttcattattttgtcatgctttaaggcccaggacaggcctaggcaaaagttttgatggccttttgttacatcccagcctttgtataagggcactggcttttagtatttaacttcattcagtcattactgaaacagttgttatggaagtctgcattagtgagacctggcctgccacaggaggttgcagtgagctgagatcgtgccactgtactccagcctgggcggcagtgtgagactctctcaaaaaagaaaaatgatgcagaaagatttgtttgacacagagtgggcataaactttcaatttgtcaaaaacatagtatctgtgaagtacaataaaatgtagtgcaataaaatgaggtatgcttggatagcaaaacatcatgttgtacctagtaaaggtatacaatttttatttgtgaattatacctcagtaaagctggacaaatgaactgtatttgcaacatggtaggaatatatgacattggacattaatgcaaatggaattttcagtgccatggtgaaaatgttataccactgaacaaaaaaaaagtagtgtgaaatgaagtaaaatgtgaaaatccgtaataaatgcagaaatatgaactgcttatccaaaagagaaaagtcttttgagttcctcaagaagattctctctttggatgctgggcacggtggatgccgggcacctgtatccgagcactttgggaggctgaggaagatggatcactggaggccaggagttcaagaccagcctgtccaacatggtgaaaccccgtctctactaaaaatacaacaattagccgggtgtgatggcacgtacctgtaatcccagctactcgggaggctgaggcacaagaattgcttgaacctgggaggcagaggttgcaatgagccgagattgcgccactggagtccagcctggaccacagagtgaaactccgtctcaaaaaaaaaaaaaaagaaagaaagaaagaaaagaaggttctctctttgggcactccttttcaacatattcagcataaatgaattaatgataccatttttactaggtgagtgtgtttgggcaagttgcttcagtgctcattctcttggtttccttttttttttttttttttttttgagacagggtctttctctgtcacctaagctggagtgcagtggagtgaacatagctcactgcagcctccaacacctagcctcaagagatcctcctgcttcagtctcccaaatagctgggactactggcatgtaccaccatgcctggctagtttttaatttctctttttttgtaagcacagggtgttgctatgttgcccaggatggtcttgaactactgggctcaagtgatcctcccacctcagcctcccaaagttttggattacaggcatgagccatggtacctggctgtcttttgctttccttatctgtaaaaactgaggataataacagtacccttacaaagttggtggaagaatgatattagttaatacaaatgaagtgctaacaaaaagagctttggaacacagcaagtacttgttaggtatggctattgtcatcaacacacttttcaaggcaaacttgtggtttcacctatcacctgagatatatgacttctaagttcatcagatcttctcttttggtttttatttttaaattaattaaatattattattcttattatttgagacagagtctgctctgtcacccaggctggagtgcactggcacgatcccagctcactgcaacctccacctcccacgttcaagcaattctggtgcctcagccatccaaagaagctgggattacaggcgtgcaccaccatacccagttaatttttgcatttttagtagagatagggtttcaccatgttggccaggctggtcttgaactcctggcctcaagcaatccacccatctgggcctcccagtgtgctgggattacaggcgtgagccatcgtgcctggccctcttttcattttagagataggaatctcattctcttccagaggctggagtgcaaaggcatgaacataactcattgcagtctccaactcctgggctaaagggatgttcccccctctgcctttggagtagctgggcctcagaactgtgccacaactactggcttccatcaagatctctgtcctaccatttcatcttcctactaggctatccccacatggatagataaatggtacctcaagtgaaagaaatcaactacctaaaataggattttccactccaaactagattttctttacatgtcatttctgttaatgtgggccacacacactggtaagctcagaatcatctttttcttttcttttattcacatccaatatggttgaaataaaacaaaatgctgtttttccttttttagaaaggcaatacttgttcattatatcaaaatttagaaaatatggaaaaacaaaaaggataaaaaattatccacaaccaaaatagcccaaatttccagttaaaaatatcaacgcatttgatatttgtccacataattaagactgtaatgtttacacaaatgtgagcttttaaaatctaaaaggctctcactattaaaaatgttttgttaaattttgttttaaaagtaagattttaatatccaaattcccaaaatagacatttttgaagatttggaaaatacagacggctgaaaatctttacattattactgttaaattttggtatgttctgttattctgctagtgaaatatatatagatttggggggctattccttttccttttttttttttttgagacaagtgtctcactctggtgcccaggatggaatgcagtggcgctatcacagttcattgtaacctggaactcttgggatcctcccgcctcgacctcccaaagtgctggggctaccggcttgagccactgtgccaggcgaatggctgttcctatatacacagttgacccttgaataacatgggtttgaactgcctgggtccacttataagctgacagaaaatacagtattggaggggcctgcatatagagaggtctgacttttcctctaagtgttccacccgcaggactgactgcgggatttgagaatgcgctttgttttttttttttaggaagtcttactctcgcccaggcttgagtgcagtggcgcgatctcagctcactgcaaccctcgcctctcagtttcaagcgattctcgtgcctcagcctcccgagtagctgggattacaggggcccacctccacgcccgggtaattttttgtatttttagtagagatgggttttcgccatgttggccaggctggtctccaactcatgacctcaggtgatccgcccgcctcggcctcccaaagtgttgggattacaggcgtgagccacggcgcccggcgggcaagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacgtcgcctcggtgcagggctccgccccgtcgcctggaaaggtgagtggatctcgaagagaccgacggcctcgacctggccgggcggcggcctcgacctggccgggcggcggcctcgacctggccgggcggcggcctcgatggctcaggcgtcatggctcccgacgggcgctgctccctggcgcgctctgttgaggcgccggcctcgacctggccgggcggcggcggcggcctcgacctggccgggcggcggcggcggcctcgacctggccgggcggcggcggcggcctcgacgtggcccggcggcggcctcgatggctcaggcgtcatggctcccgacgggcgctgctccctggcgcgctctgttgaggcgccggcctcgacctggccgggcggcggcggcggcctcgacctggccgggcggcggtggcctcgacgtggcccggcggcggcctcgatggctcaggcgtcatggctcctgacgggcgctgctccctggcgcgctctgttgaggcgccggccggctggcgcagtcctgtgggcggcgtggcgcttgcaagcgcaggaagagtcctggggggaccgcggtgggcgggatacctttggcgccggatcttcctctttctcccggtttgttcccgacggtgctcgctcgtgggcccgccctggcccgggctttctggccccatagtacccgcgcggcctagttctcgggggcttgggcacccgggtgctgtatcggcgggtttcttcccatgtcctggacatttactttatatgctgcggcggaggtcgtacctccttggcctggaggaacccagtggggactgacgcagctccgggtgagctttggcggctgtgtcgagtgacaacgtaggcatctcagcacggacatttgcagtggcccgacggcgcaaatgacaggggaagtccccttgttttgagtatgaggtgtttgtcgctgtccctttataagggtccaactccactcatactcacctccctcgccccccccccaccccgcccagaacactttggtagctgcctttgcttaaaaaaaaaaaaattctaaagttcttacaaatcgttagtatggcttacaatttttaaccttttccacaaatgtttttagggtatttttcctctttacaggtaaataatgtgatctattttggattcaataagactttagtaattggatctaaagagtgacggaagaagctattaaaggtggatgtgcacagaatcttgagtcagtttgctttggcttgaataatcacagcactgtcgtttataagctgggtatttggggccagttacacttttcatccatagatggagttgtaacattaatagaatttgataggatgatccattttaaacatttagggtattgcttgacacatagcactaagtgttagctacaagtcactgtttttattgttgatgttaaaaggatattggcggggcgcagtggctcacgcctgtaatcccaccactttgggaggccgaggagggcggattgcctgaggtcaggagttggagaccaacctggctaacatgtcgagacctcgtctctactaaaaatagaaaaaaagttagccgggcgtggtggtgcacacctgtagtcccagctacccgggaggctgaggcaggagagtcgcttgaacccgggaggtggaggttccagtgagccgaggtcgcgctactgcactccagcctgggcgacagagggagactccaaaaaaaaacaaaaaaaaaccaaaaaacggaaactcaacggatgaccatgattataatagtagcataattgtgtctcttatcataactaagcatacgttatcttattttgcgcttccagcaaccctgtggatattgagacctgtagagatttaagatacttgttcagggtgaaataggtagtgcagcagaattttggcagtgggtctgatttagtttctcttgggaacagtggagtaagttacagtctattcctccagagaagaaggatagatatctacttgtacattgtaatttcaaactgctagcatagtataaatatgaatgtgatgatagagtctaaaacagaccttaattgagggttcctgtaactcctgaaattaaagactttaatttttgtgttatttttttttttttaggtggggtctcactctgtcacccagctggatgcagtggcgctatctcgactcactgcaacttccgcctccccagctcaagcgatcctcccacctcagtctcccgagtagttgggaccacaggtgtacccaccacacctgctgttttgttctgttttgtttttatttttggtagagactgggtttcaccatgttgcccaggctgttcttgaactcctgggctcaagtgatttccccgcctccacttcccaaagtgttgggattataggcgtgagccactgcactggccattattttatttttgagacaaggtctctttctgtctcccaggctggagtgctgtggcaggatcgtggctcactgcagcgttgacgtcctgggctcaatccatcctcccaccttagcctcctgggtagctgagactacaggcatgccagctacaggcatgcgccaccatgcccggcttttttctttaatgtagagacggggtcttaccatgttacccaggctggtctccaactcctgggctcaagtgatcctctcgccttggccacaagtgctgagattacaggtgtgagccactctgctcagcctgatttttttttttttaaacaagcttaaaaaaaaaaaaagcatgtttagagcctttctgagattcttagtggggatcttggcttccaaaagattaaaaaccactggtctagacagaagttagaatgttctttcaactacataacgtctccattaaataaagtggagtggtagcaacattttgaggattggttattatgaccacctctcttacacttagagtcttttttttttcccccaaatttaaagtcatttacattagaacctggggatttcagcggaatatggattaactagtgagtaactttggaacatgtgaagctattctgtaaagttaggtttgagtgaaatgacaaaacagggtgctttggatagaaggtaaggaatggagggagaagaggcagtggctgtgaagaatataaagaggttaatattctcccccagtttggcagagactggccatctgtgaactgcccatgctttctagaatgtctgagttttggagtgtgatgatgcgtctgtatatcatatctttctagtcttccattgtgctttcatttgttagtcttctcttgttttgccatttttgtactccctcacatgtgcttttgcccttcttaaaaatattcttcgtctgtaatccaagcactttgggaggcagagagaccagcctgaccaacatggtgaaaatccgtctctattaaaaatacaaaaatgagccgggcgtggtggcagcgcctgtagtcccacctactcggtaggctgagacaggagaattgcttgaaccctggaggcagaggttgtggtgagcagagattgcgccactgcactccagcctgtgtgacagagcgagactctgtctccaaaaaataaaaaaataaaaaaatatataattctttctctagtttttctttttccagatggcttctgtttagtttttctatgttctgtcaagttggtttcttattctgcagctgattcctacttctcaaactctacttgacagctcttatttttatttatttgttttttagaatagggtcttgctgtgttgtccaggctgccatcaaatttttgggcataaatgatcctcctacctctgttgcctgagtacttaggactacaggcaggcacctttgacagctgttagttgttttttctgccctttacatctatacttcatgcttctgagtaacacacacatatacttttgttattttgaattccctttctcccattttagacattttgttttcttttttttttttgagacagagtctcgctctatggcctaggctggagtgcagtgtcgcgatctcggctcactgcaaactctgcctccggggttcacgccattctcctgccccagcctgtagctgggactacgggcacccgccacaacacccggctaattttttagtatttttagtagagacggggtttcaccgtgttagccaggatagtctcgatctcctgacctcatgatccgcccgcctcagcctcccaaagtgccgggattacaggcgtgagccaccgcgcccggccccactttagacattctgtactggctattatgctcctccaaaactgtcctcagacactttgctttgcccctcattgtttcagtactgttattggagtttttgtttaaatgaatatttaacatttatataaatataaggtaaatattttgcatttgaattgcccttgttgtgcagttttgtttttcctggactgaataattgctttattttttggtttgcttgtatgttgtgttactacttggttacttaaactcagcaacttaaaccctcaaatgtggtcaaactggtcacataatccgatcaatttcagcttaaaacattgattgattgattgattgattgattgtctgtctacctggaatacccttactaaccgacttctccaacccagattggtttttcttcctctttgctacacagctgtgctcttgggacttccctttatcaccagtttgagaattcccttcatcttttttctgagttagaccctttgtttcttgtatctcatgtcatcttcatttactttctttgttttggtgtagcatagttcacttgctttgaggaaaagtggatgagaggtttttttgtttgtttttgttttgggacagagtcttgctctgttgcccaggctggagtgcagtggcatggtctcagctcaccacaacctccgcctcccgggttcaagtgattctcctgcctcagcctcccgagtagcgggattacgggtgtgcgccaccatgcccggctaattttttctatttttagtagagatggaatttcaccatactgttcaggctggtctggaaactaatggtatgtctttaaaacatctttacttaatttagttgatcatttggttatcgaattctgagtttgaaataatttttttcgcaattttgaaagcattgctccattttccagaagttctgttgttaggagtctgatgagagtcttgttcttggtaacaaaggttttctggaagtgtcctttcaattgggaaactcatttctttcagttctgtagcgtttcttgtattatttctttgaccatttcttaccctttttttaatgatgtttacctgaaagctggagtttctctaatttttctcttattctcctcttttgtttgttctgccttttgagagatttccttacccttatgttccaggggaagaagattggggaattcatgtttcagtatctagacttttcctcattgtcctgtataatcacggccttcacccttgttgggactccacagatttggagctgatcagatcggtttgttgagaacagcagcttttttggaggattttagggggagggagattcatttgactgtgcaagatgggcgacagagcgagactccgtttgaattaaaaaaaaagagagagaaatttagaactgcataatgaaaaagtaggccacaaatgttaagttttggacaattacaattacatctctatcttactgtgcaagatagcgatgatgtggcatctcttagggtcttactgttcctgttttcagccctgcatcagttcttgatatttggcagcttaagtgaattcaggtatttgcttatagtgacatctgctgtcatgtaaagaagtactgcttgaatcagatattgtcctgtttacataacgtgggctgtgctccttcctagctgtatatctttaaacaaggcatttgcctgcttgagcttcagttcccttgtaaagtgaggttagaggcaaaagatcatacagaagaataatttgtaaagttgtttaattatcttaagattgtctactttaataacatagttggaagcaaagaaggtaatggaattatttttctattatgttttggcattgtaccttgaatctatttcttcattttgaaaagggggaactggccgggctcggtggctgaggcctgtaatcccagcaccttcggaggcggaggaagtcagattacaaggtcgagagaacgacaccatctggccaacatggtgaaaccccatctctactaaaaatacaaaaattagctgggcatggtggcgtgcgcctgtagtcccagcttgtacccgggacgcagaggttgcagtgagctgagatcgagccaccgcactccagcctggcgacagagcaagactccatctcaaaaaaaaaaaggaagcggggaacaagccttgttcctttatgtgctgtcctgactgttgtgtattatttttgttaagattgctatagttcttttttttttgagatggagtcttgctctgtcgccagtgctgggattgcaggtgttagcctggcattgagcaacgttttgtaatttaagcatacaagtctctcacctccttgtttacatttattcccaggcatttttttcatttagatgcgattgtaaatggaattgctttcttaatttccttttctgattgttcgttgctggtacagtagtcccttcttatccacagtattgccttacgtggttttacttacctgcgtcacccgtggtccaaaaatattgaatggaagattatataaataaacatttcatgagttttaaattgcaaacagttctgaataacatgataaaaatctcacagcctcctgctccgtcctacccaggacacgaatcatccctttgtccaatatattcatgctgtatgtgctccccacccgctagttacatactagccatctcagttatcagatcagttgttggagtattgcagtgcttgtgttcaagtaacccttattttatttaaaatggcaccaaagagcaagaatagcgatgctggcagttcacatatgccagagagaagccatatagtgcttcctttaagtgaagaggtgagtttttgacttaggaaagaaaaaagatcgtatactggggttgctaagatctacggtaagaacaaatcttttgtccatgaaattgtgaagaaggaaaaagaaatttgtgctagttttgttgtgacaccccaaactgcaaaagttacagccacagtgtgtgataagtgctttgttgagatggacaagacattaaatttgtgggtggaggacacaaacaggaaacatgtttcgattgatggcaacctggtttgatactgttcatcgttttggacattcactggggtcttggaatttcaaaaataagatgtttgagtggctgtatactctttatcacatggatggaacatactctggttgtatcagcttttttttttttttttttttttttttttgagatggaatcattctgttgcccaggctggagtgcagtggtgcggtcttggcccactgctgcctcccgggttcaggcgattctttgcctcagcctcccaagcagcggggattacaggcgtgtgccaccatgcccagctaatttttgtatttttagtagaaaggaggtttctgcatgttggccaggctggtctcgaactcttggcttcaagtgatccacccgcctcagtctccgaaagtgctgggattacaggtgtgagccaccgcacccagcctggtgtgcatcagcattttggactttggagtttacgtaaccaaggagccaggctgtggaccttgtttattacttgaagaattcaatatttatttctgcctttttgactccttgactgtaaaatactgatctgatctgtagagagaacagtacatgtactattaaggcacagggaatcctcagtgccttaatagatcgtaagtacttacttattctttcccatagaggcttacacatggtaggagaagagatttctggaatacctttcctccccaaagaaagctggtttcttttgtttgttaagtgagagagtggtaccacagggtttccaagatttccaaggctgatgaaaattcttaacttctgttgtctgcttgtcttgctttcttgaatttattttttgtatgttatgtatttattatttagagacaggatctccctgtgtcacccaggctggagtgcagtgtcacagtcataactcacggcagtgtcaacctcctgggctcaagtgattctccttccttggcctcctgagtagctaggaacacaggcatgctccactatgcctggctatttttttccccctggagacaggatcttgttgtgttgcacaggctggtttcaaactcttggcctcaaagctagcctcccaccttggtctctgaaagtgctagaattaaatagaattaaaggtgtgaccaactgcacccagcttatttatgatgacgatgatgatgatgtttgggagatggagtctctgtcgcccaggctggagtgcgatggcacgatctcagctgactgcaacctctggctcactgcaacctccacctcctgggttcaactgattctcgtgccttagcctcccgagtagctgggattacaggcacccgccatcatgcctggctaatttttctatttttgtagagacggagtttcaccatgttataacgccaggctggtctcaaactcctgacctcaggtgatccgcccacttcggcctcccaaagtgctgggattacaggcatgagccgctgcacccagctctattttttgttttgtgataggaaattataaaacatggaattatgcatttgtcaggctttaaaaaaaacttttaagtgaatgaaaatggcatatttgaacataaacttagggcagatttttactacttttgaaaaaatgttggagaatatttctgtatgaaacgtaaaacaacttttaattttttttagaagttgagaggattctattttgcaaagctgtattatgaagctaaagaatatgatcttgctaaaaagtaagtacaaactgtaacatgtattctttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattgtttggcttaaaacactttttctaaaaattgtcttctgttggagtaaaagaggaccatgcctatatcttcatttgtttttggttagatatctgataccttaatcagatggaaaatagcaatgaataaaaaactgtaattgtaaggcaggagaatagcttgtataaaagatctttaattgacacaatatgtgatgctctaaggctctatcctagggataagaagcttggtgattctgatttcctgactgggagtggattaaagcaggaaattaagagggaggcagggtttttttttttttttttttttttttaggcagtatctgtctctcttgctcaggctggagtgcagcagctggctccatctttgctcactgtaacctctgccttctgggctcaagagatcttcccacctcagcgccccaagtagctggggatacagatgagcaccaccacacctggctaaggtttgcattttttggtagagacaggtgtcactatgttgcccaggctagtcttgaacttctgagcacagcagtctgcctgcctcggcctcccatactgttgggactacaggtgtgtgttactgctcccagctgggaggcaggcttttaaaggcatccaaaggaagatggaaatgctggtaagaaaggaaaatggtggtacataaattatgtaactagcagcactgtgactgttaactcttgtacctttttactgtgagactttaatcccttagtttgggtctggcctaatttctctgatggtaatactgtcaaggaacctagaggatatttacttattttagttgttacttgatttgagaaatggaaatttcctgtatttggtactgtaattagtaatttgtcttctgttcgattttagctggatatagtactgttagaaattactttcttgcttaaagggtaggtgtatttccctttgttgtttgggaaattgttgctgtttagtattttgcattatgataactttaaaaatgtttactataatcacttctaatttatttgcaaaactgttagtgctttattaaaatgtgatcaggaagaaaaagcaatttatatgttcatttcttatgcgtggataacactggagaaaaatttggtaaatgtgacatttaatggtaaaacgagtatgtggtcaactctatgtacgtgtttttaagtattacccatttctttctatgaatacttctgagttatctgcataaatagtggtagttttgagtaacaatataaacgagtttagtggttgctttggtttaagatgtattcttcggttagcatttaaaagtacagttctaagtttaatttacttttgtattacttttgaaaaacagatacgtatgtacttaccttagtgtgcaagagagggatcccagagctcacagatttctgggtcttctttatgaattggaagaaaacacagagaaagccgttgaatgttacagggtaagttataggattcaaatatagcctttgcatagccaaacacatgatgcccagagaaatttatataagtaagtcaaatatattttatgaatatcataaaacaggcattggtatcatagtacaattatgtgacacagcttggaacagatttagaattgtttaacacctataaattgtaagtctaacatggtcagaaatggtgttcttttgtgttcttttgcattcaaatgacacaaatataatttttatttgattcatttccagaaaattccaagacacttttattttaacacctttgaagtaacatgttttctctagaagtagaattttttaagggttggagtgataatttttaacctttatatataagtatataagtatatatactcctacatacatacatacaatttatttactaatctttaatttcttttctgatattagcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggtaaacatacaaaacataaagggagaaaacttaagacataaccatttctaatatttggagtttaaattacttttcaatagcaaaccttaagcccaggtgtttgtgtttcctttaacatttttcttttaaaaagtgtattaaaacctttctgagcatctgctgtcttattaggcattgttatactttataagtgacatctcatttacccttctggaataattaatattttagggattttacagtttagtagctgtaaactaagtagagctaagatttacattaagttctgtctggtatacaatttttgcttcattaagtgaaaattacctacaggatgacaatttagggatattttaaagaagagttttctaataactatggtctgaaagtagaagggattgtattttgagatagtaaagttttcaaggaaaagataaaaggtggtttctctagtatataagatgtaattactaaaaatggtaggaagttcttgctagtgtattgactggtcctgatattctttatagagcaaaatatagtttactaagtaactgttctggagaaaatctacacaaatatgtttggcaaacatttaaaatgtatattgtaatattttatatattaatgtatactttattgtgtatgtacaatataaaattataaatgtatatttgcctttagcctcctcctacccccattgtatatgtttctgatagaaatttaaaaaattttaattttgaaataattatagatttttttgcacaggaagttgcaaagattgcacagaaagatcctatatgctacttcatttttccccaatgcttatacaggttgagcatttaaaatctgaaatcctaaatgctccaaaatctgaaattttttgagcactgacatgatgctcaaagaaatgctcattggaaaattttggatttcagattttcagatttgggatgctctgcctgctaagtatcctgcaaatattccaaagtctgaaaaaattcaaaatctgaaatacttctggtctcaagcattttggataggggatactcaacctgtttaacccgaccaaagcacaatatcaaaatcaggaattttgacattggtacaatgtgtatgtatagttttctttcattttatcatgtgtagattcataccaccactactgtcaagatacagagctactctattaccacagagatcttcctcatgctgccccttttgtagtcatgctatttacttctcttcactatgcctgacctctggcaaccattaatctgttctccatctttatactttggtgatttcaaaatgttatgtaaatgtcatcatgaaatgtgtgacttttttttttcttttttcgttgtttttgagacggagtctcgctctgttgcccaggttggagttcactggcgcaatctcggctcactgccacctgtgcctcccaggttcaagcaattctcctgcctcagccttccgggtagctgggactacaggcacatgttaccgtgtcccgcttatttttgtatttttgcagaaacggggtttcaccatgttggcctggctggtctcgaactcctgacctcatgtgatctgcccaccccagcctcccaaagtgctaggattacaggcgtgagccaccgcgcccagccaagcatgtgaccttttgaggttggcttgttcagtcagcataataccatttgtgatccatattaagttttgtatatccatagttggttcctttacttctgagtagcatttcatggtccacaatttaaccattcactttttttatttttatttttttgagacagagtcttgctctgtcgcccatgctggagtgcagtggtgctatctcggctcactgcaacttctgcctcccgggttctcaggtgatccacccactttggcctcccaaagtgctgggattacaggtgtgagccactgtgcccagccttaaccattcacttttgaggggcattttggttatttctaggttttggctgttgttcaactgctatgaacaatcatgtccagatttttgaagctgaaaaagcattgaagatgcttccaaagataaatattactgataagtttttctccccagtaataagcagctggattttaaatattagtctaaaacatgaggtctaattgtgcagatttctttactctcttaggtgttatgcctcaaacataactcccatattgggcgtggcaatccagttaatctggtgtcagtagtgttaaagaacatatgtaatggcaggagattgttttcttgcagtgtaacaagtaagatactttgaagcactctttaaagattttctttaataacttgaaggcactgttaacacctttcctgtatcagattttttttttttttggaattgaaatccatgagatttataattgtcatgcaaagtaattccatttctcctaaaatttaaggcttgctaaggtaaacagtttctgacatttgtttaatgaatgagagtattactgttgagaaggctttttctctcaagtatgagatagaactttttaaaagcactcatagtggttttttaaaaaatgtttaacatagagtcaaagactagggcttttgcaatagggagagaccagggtatcatccatctcatccagaagaggagaaattgataaaggagagaggggaatgaaatacagagtagtaatggacggcttggtcttgagagctggggaaagacgagtttaagtaggtaaggtaaaatggaatttatatgtgatagcatcaggtttctcagtgaaggatgaatctaggttataagttgaaagtgagggtcaaaggaaggtatggggaagttgaggaaataggaggaggtgtgaagtgtcagggagtggagaaagtgagtctgttagtactaaaatggcattttgttttaggcagcaccagtttgatggttgagataatgcaaatgaaatcagttagcttggggttatgatttcccaaatctaagcacacagaaaccagttgggagggttctgaggaaaagagggaattagttgaagggatctgtaagcaaacagtaattatggatataagggattatagcattttttgcctgacagaagaaagtgtgtgtatatgtgtttacaggtgcttaaaacttgatgatgttattgtcttgaagggaacttgtcatgtggtggagaagtatatttctgaaagtaagggtacgtaggccctcagtgaggtggaagaataagaaggatggtatggtcgtttcggtggtatgaccaaaatgcagattttgaagacctgtgtcagtggcaagtggatggttgaggttggagtagaggataacatgactggagatgaggtgattaaggaactgagtagtcagcctgggcaacacggcaagaccccatctctacagaacgttaaaaaaaaattagccgggcatggtggtgcatgcctatggtcctagcttcttgagaggctgatggaagagcatcgcaaatgagaagcgagtggccacaaaccctacttcctctccttgtatgtaagttcagagagaaaaagccatcatggtagtgggggttatcctgagatgatactgtcttcatttaagatcaggaggtgatgacagtgctttgagatgatgatgaaggtaacagaacagtgggaggagaggggatgtgggattgagtcagatttaaggagatacagagcagtttgagcataaggaccttgttgctgaggattgactggggaggtctaggcttctggtggtgactcagatggacagggatgtgtggcaatagtcctggtagtctctgaagagagtatgagctactgcagtaatcacagatgcttttcttcacatacagttcttgaggcttagtttctgggttgtaagcaactctcagaagggacgaataaggtatataggatggtgtttttggtggcatcatcataaaactagacatagtggaatggtgctttttgggagcatgacttgtttaaaattgcacaagtgttactctaataatttttctttttcccctctaaataggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggtagataaaagctattgggtctttacatttctatgtaggcaattagcatacatctttttgtactaaagcagcagtgccccgcaggacttaaatttcttttatttaggtagaacagttataaaatgaaatttttaccaggatcagttaaatttataatgggaaagttggggagataactatgataaatgtatatatttttggtgttttcatttataaggttgatgtaaaaatcaatgtagtttcacaaacgtggttagagtgagaaaaggaatttgtaggcataaaatggttaatttcttaacacttgattaagttttgtaacttactattcattccacaaaataggaatatctggagtctttacagtgtttggagtctgataaaagtgactggcgagcaaccaatacagacttactgctggcctatgctaatcttatgcttcttacgctttccactagagatgtgcaggaaagtagagaattactggaaaggtgcgttgactttgaggagaatgctttagtataaattgtagtttttctttttgcagtaagttcattgctctaaatttctttactgcatcattatttctataatgtacctaggagttatagttaatacagtgaaccactaggaggcaatcttatttttcttcttttacggggaagttctaattggttttatatgactttcctttttagagaactcttatagttcaagcttgattaaaattagccttatggttaaatactcaggtttgtcatagtcaagcttaaaatgaatgttctaactgctatttcatattttattttttataatagtataatcttgagtgaaaattaaggttcatctgtcatcagatggctaggttcacatgtactagtataagcacttagcatcactggtatttcagaaaatactgttttagctaagaaacaaaataactcaactatgtgatttaccttttttcctaaattttgattttgaaaaccagtgtctccattttgaaaataaattccattgaacaaaaacatcacttggatttgtataaaaatgttagtttagagcaggggttggttagaacttgtgggccaaatatggcccctgcctaattttgttaatatttattggaatgcaacatgcctctgtttatgtattgtctgtggctgcttacatactacaaggttggaattgagtggttgcagcagagattgtatgcctgtaaagccagattagtaatctcctcctttttgtagaaaaagtttactgattgctagtttaggctgtccatttgtttggaagttaatttatttccccatctggtataaggaaagaagttcatttcactgagtgcagggagtaggtaattttcttgaaaaagtacatagtgtcctaaattggtagggtaagagcagtatctaaaagaactaacataactttaagattattttagaaaacatgtaggatgttttattttgtgttctttgtatactcaaattttttggtcacaagttccttttacatttttcttaaggacatcaaagatctttgtatgtgggttcctttttttctttctttctttcttttttgttttgtttttttttttttttttgagatggagtcttgctctgtcaccaggctggagtgcagtggcatgaccttgactcactgtaacctccgcctcccgggttcaggcgattctcctgcctcagcctcctgagtagctgggaccacaggcgcacaccaccacgcccagctaatttttgtatttttagtagagacggggttcaggatggtctcaatctctctttttttttttttgagactgagtcttgctctcgccaggttggcatgcagtggtgcagtctcggctcactgcaacctctgcctcctgggttcaagtgattctcttgtctctgcctcctgaataggtgggactacaggtgcccgacaccacacctggctaattttttttttttttgagacagagtctcgctctgtcacccagcctggagtagagtggcgcaatctcggctcactgcaagcttcacaatttcctctcaatgctctgaataagagcttatcctcctgcctcaggttgttccccaccaggaagccccaggagggccctgaggacagcccttggccctcagagggggaggctcaggaggggagatgaccatggggatggagtcactcaggggagaatccggaccatgagggggtgactgggggcctgaggggaggaccctgaggaagataaaaagctggtgccaccctaggcagtttcacagtgtggcttagggtggtgggtgacagatggtttgtcagatcagttaatcaggactcatgggccctttgttacccccccttgtgaacctcccaggttcacgccattcttctgcctcagcctcctgagtagctgggactacaggcgcccaccaccacgctcggctaatttttttgtatttttagtagagacggagtgtcaccctgttagccaggatggtctcgatctcctgacctcgtgatctgccctcctcggcctcccaaagtgttgggattacaggcgtgagccaccgcgctcagcccacacctggctaatttttgtatttttagtagaaacagggtttcatcatgttggccaggatggtctcgatctttttttttttttgagacggagtctcgctctgttgcccaggctggagtgcagtggtgccatctcggctcactgcaagctctgtctccagggttcatgccattctcctgcctcagcctcccgagtagctgggcctacaggtgcccgccaccacacccagctaattttttgtatttttagtagagatggggtttcactgtgttagccaggatggtcttgatatcctgaccttgtgatccgcctgcctcagcctcccagagtgctgggattacaggcatgagccaccgcgcccggctggtctcgatctcttgacctcttgatctgtctaccttggcctcccaaagtactggaaggtctcaatctcttgacgtcgtgatccgcctgccttggccttccaaagtgctgggattgcaggtctgagccactgcacctggccgtatgtgggttatttctgtcagtgtttattacattagaaattaaaacaaataaaaaatgtaatccattaaaaatgtaataagccctattgtgtgttaataataatagctttttttttttttttttttttttttatttgagacggagtttgctcttgttgcccaggctagagtgcaacagtgtgatctcggatcactgcaacctctgcttcccaggttcaagcgattctcctgcctcagcctcccaagtagctggaattacaggtgcccaccaccacgcctggctaattttttgtatttttagtagagatggggtttcaccatgttggctaggctggtcttgaactcctgacctcaggtgacccacccgcctcagcctcccaaagtgctggaattacatgtgtgagccaccgcgcagggccaataatagcattttttatgaaaaataattattttccaacagcaaaaaagtagtcagaaaagtgtcattgtttttgcatttttgtaaatctttttaatgtctcgcttaatagaacatagctagattctcatttacttcctctttcagtctgtaaaactattacatgtcatgaagcctctagaaaactcagctcagcgggtcgcggtggctcaggcctgtaatcccagcactttgggaggccgaggcgggtggatcacgaagtcaggagatcgagaccatcccagctaacaatggtgaaaccttgtctctactaaaaatacaaaaaattagccgggcatgttggtacgcgcctatattcccagctgctcgggaggctgaggcagaagaatcgcttgaacctgggagtcagaggttgcattaagccaagattgtgccactgcactccagccttgtgacagagtgagattctgtctccaaaaacaaaaacaaaaaaactcagctctacatacatgagaaaatgagtatgtaatatataaatttttttttggtattattgtaaaagtaattttaacttcatggatcccctgaaggggtttttgagcaccctcagagatctttagacctcatttgctctggttgcgttattgtaagccactttaaaatcatgcttcacgtttaagtgtttgctttttgcttttacttttcttccaaagtgaggatttggagaaacattaggatttagaagaactaatttagaatatagattacaaataataggccaggcatagtggctcatgcctgtaatcccagcacattggtaagctgaggcgggcggatcgtgaggtcaggagttcgagaccagcctggccaacatagtaaaaccctgtctctactaaaaatataaaaaaagtttagcggggcatggtggcaggtgcctgtaatcccagctactcaggaggctgagtcaggagaatcacttgaacctgggaggtggaggttgcagtgagcttagattgtgccattacactccagcccaggcgatagtgagagactctgtctcaaaaaaaaaaaaaaaaaaaaaaaaaagacaatttatttaacgctgtaatgatctatatagtaaaaagagcaattgctgtattgatactcaaatacctgtcagttatttacttataatttggaaatggtatgtctaatttgagaaattacaactgttaattaaataatgaaattatatgatcaggaagaaactacaaaatagtctcccaactttatcctggtttattttgaaatgtgcacctataatcactaatcttatatttatcctgtgattggagggctggaaataactgggaataagacatcatttgagaggttaagcatgaagtataggaagtatgcaggataaaaataagcattagatgattcataatttataacatggggaataagaattattagaagttgaatgtggaagatgaagcttgaaataaaatttttattttgttttgaattaaatgaaccatgattattcacagtgcagtaagtgtgtatcatctgtttgatattttcatattacagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggtaagtcttccacttgtaggagcaattgacatttcacggagtcttgatgtgttttaaatgaaggtgtgctctggtatgtaatgacaatatgtgaacaaactgtggaattaaaatgaaatagtcaatttgatacagtggaaaataactaagcatacacaatactggtgaggctggtgaaacagggatgttgagtgcactcttgtcgaaagcctgcattgccatgatttgtttgtagacaaatttgaagagtttgatctttttactctgccatttttgggaacatgataaagatgtaatctcgtattatgggtaaagcttgattcaaaaaggtgtgttacttggacaaaatcctaataagtagatgtagggcaatggctttatagcctatgatagaagaatatgattgcaatttaacatgttaattgaaacacatgtatataacatttatggctgtattgtgtatatgtaacagtatatctattaatctttgaaaacataaaaccttttcttattttttatttttttattttttttgagaccaagtctctctctgttgccaggctggagtgcagtggtgtgatctcggctcactgcagcctccacctcctgggttcaagtgattctcctgcctcagcctcccgagtagctgggactacaggcccgtgctaccaagcccagctaattttttgtatttttaatagagatggggtttcaccatgttggccaggatggtcgcaatctcttgacctcgtgatctacctgccttggtctcccaaagtgctgggattacaggcccgaggcactgtgcctggcgtgcctggcctttttttttttttgagacggagtctcgctctgtcgcccaggctggagtgcagtggcacgatctcggctcactgcaagctccacctcctgagttcacaccattttcctgcctcagcctcccgagtagctggaactacaagcgcccaccaccatgcctggctaatttttttgtatttttagtagagacggggtttcactgtgttagccaggatggtctcaatctcctgacctagtcatccacctgcctcggcctcccaaagtgctgggatttacaagcgtgagccaccattcccggacttttttttttaatgagcttgcataacttttgaaaggaaaagaaataagcagtcttccaaaaaaagcattaaaccaggcttagaaaaatgattaattttagagaaggattttttgcttggggagggaaaaaaaaggattcattacttttagagaaggcccctccttctaatataaatctttttttctttttgagacagagttttgctcttgttgcccaggctggagtgcaatggcgccatctggctcactgcaacctccgcctcccgggttcaagcgattgtcctgcttcagcctcccgagtagctgggattacaggcacacgctaccacgcccatctaattttgtattttcagtagagatgaggtttctccatgttggtcaggctggtcttgagctcctgaactcaggtgatctgcgtgtctcggcctctcaaagtgctgggattacaggcagtgagccagcatgccctgcctaatataaatctttttatttttatttgagacggagtctcgctctgtcaccaggctggagtgcagtggcgcaatctcagctcactgcaacctgtgtctcctgggttcaagtgattctcctgcttcagcctgtcacgtatctgggattacaggcacacaccaccatgcctggctaattttttgtattttttaatagagatggggtttcaccatgttagccaggatggtctcgatcttctgacctcgtgatccacccgactcggcctctcaaagtgctgggattacaggcatgagccattgagcctggcctgtaaatcttttaaaaacaccgttgatagacagttcacatgttaaatgctaatattggctcagtagaaacttctgtgttcataaggaatggattagtgaaaattaatggatttagtgaggttcactaggtaatacaaacattaaaaggttcttatagaaattctcaagtaactgatagttcttatttttatttattttatttttttttgagatggagtctcacactctgtcgcccaggctggagcacagtggcacgacctcggctcactgcaagctccgcctcctgggttcacgccattctcctgcctcagcctcccgagtagctgggactacaggcacccaccaccacgcctggctaatttttttgtattttcagtagagatggggtttcaccgtgttagccaggatggtctcgatctcctgacctcatgatccgcccaccttggcctcccaaagtgctggcattacaggtgtgagccaccgcgccctgccaatagttcttatttttaatggaaactttaaaatttatctgtctgtgtgtctattagagtcttgctgtgtcacccaggctggagtgcagttgcgtaatcgtagctcaccgtaacattgaactgggctcgagcttcccagagtgctgggattataggtgtcagctactgcgcacagcctaaaatttttcgatatgtagttttgggaggcagagtctcactcttgctctggctggagtgcagtggcatgatcatagctcactgcatcctcgaactcctgggctcaagtgatcctctcctgcttcagcctcagctcagtagctgggactacaggtgcctgccaccatgcctggctacattgttaaattttttgtaaagacaaggtcttgctatgtttcccaggctggttggtcttgaactcctggcttcaagtgatccttctgccttgccctcccaaagtgctgagattacaggtatgagccaccacacctgactgtgaacttttaatcataataagttagtttccctcttaatccattcactcaggtctcctttcctagatgacagctactgttaggagtttcttgggtgttcagaaatattttttgcatatgcaaatgtgcaatacattctttctctgcttttaaaaaatattgtgcctcaatgtgggtgtgctttacctattgccagatgccttgcttttctgaatgtttcttcattgttccacttcagcacagagatacctacctcagtctttattagctaccacatatttctgtagaatgaatatataatagaaacatcttagatgcttgtattttatttgatcagtttattttaaagcttaatgaacaaatgattataagcataaaatgtaggttatgtgctggcatttgggtatttaagaattggctaacttttatggcaagattttcagactcttaatcagaggaatactgtggttctagtaagtgcatctgcattgcagctaggtagttaacaaagtatcttgaaaccttttagttaagatgaggaaatagccaggcgtggtggctcacacctataatcttagcactttgggaggctgaggcgggcggatcgcttgaggtcaggagtttgagaccatcctgaccaacatggtcaaaccccatctctactaaaaatacaaaaattagccacgcatggtggcaggtgcctgtagtcccagctacttgagaggccgagacaggagaattgcttgaaaccaggaggcggagattgcagtgagccgagatcgtgccactgcagcactccagcctggcgacggagcgagactccatctcaaaaaaaaaagaggaaatagtgaattgagatgatttgattgagtggattcacaactaattaactggtcacagattcaactgttgaataattttgtaaaagaggccgggtttatgaattgaggtcagtttgaaaacaaaaagaatgatgtcaacattttgtttcttactttgtgtgctcttttcaacatatagatgacaaactttgacatgatgtttagaaaacttgtgagtaaaaggataggcgatatgaatatttctaaaattcaaaatcagaagcttttaggttcataaatcatatattttgaaaaatgagcatgtttggaaagaattatatatacatggtttaaaattctggcggctcttaagaatatgctatgaagactcctttctgttccctagttatttactttctccagccccaaagaaactaatgttattgctttcttgtgtgttcttcaggaaatgttttatgcatctccaagtaaacacacatatatcccctgtctttaaaagaaggaggaaaacatttgaacattgcatttactttatttccattaactgtatcttggagatgtttccatgtcagtatatataaagggcattctcattagtttggatgcttgcatattattccattgtatggatgtactgtagttttggagtttttaaaaccagggtcctaaaaccaggacattagcttgcttttacttttttttttaatgctacttcaagtaatttagcaatgattaacttgtgccatgaattcctgaaagaattgcagtatcaaagtatatctgtgcatttataatttttagagctgttgccaaatatctaaccctaaagaggttgtatcaaattacatttccaccaccaattaagaaagtggtgatagaattaaaagccgatgctctagtcacccatatagttacttttggcatgtttctagtaagtgggcattgcctgtgactggacgttttcagtgatgggcattcattacttttcaagatagcccagtgcatctttaggtggtttggctcttggtacttccttatatagaataaaaatattcttcaagccttctacctgttggtcttgtttcttcttttgatgatttcttttataaaataattttaatacctgaaggcagctgtcacgtcttcccttcgccattctattcatcatgctttttttttttccataggttattgcattaggatctctttaatttcctggttgtcccatttattctagtgctatcccctgttatccatactctgaaaatgtgttatctacaatgtggcatttccaagtgtcatttcacctgtactttttaaagtagggtgtcatatctactcaaataggacaacatctgctgttgtcctatttattcagggcagaaaagtaatataattaaattttccatttctctgaatgtaacacgaatgtgcttttagtagaaactaatttctcagagctgctctgtgtatgctttttttttttttttctttttttggagatagggtctcactctgtcacccaagctggagcacagtggcatgatcatggctcactgcagccttgacctcctggatttaagtgatcctcctgcctcagcctcctgagtagctgggaccacagttgtgtgccaccactcctggctaataaaaaaaactttttttagagatagggtctcaccgtgttgttcaggctggtcttgaactctgggctcaagtgatccccccacctcggcctcccaaagtgctgggattacaggtgtgagccaacatgtctggcccctctttttttttttttttgcgatggagtctcgctctttcacccaggctggagtgcaatggcgcagtctcggcgcgctacgacctctgcctcccaggttcaagctatccttgtgcctcagcctcccgtgtagccggaattaacaggtgtgtgccaccacgcctgcctctttgtttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagacaagaccatgttactattagaagtatgggtatcatcaaattaagatttttgattctaaaattattaggttccaagaccaaagattaaattaataaaaggtgaagctggacaaaatctgctggaaatgatggcctgtgaccgactgagccaatcaggtaatagtaatattaaactaatttaatttaaaaagaaaaaggaatttctgttaaggcatatcttatgataaaatcttcatctgtccaggagataatttgtcaaaattatttctttttgccgtatcagttaagagcaataggtatggaagagatgcgaagaaatagcacattctttaaaaaaaatgaatatttgatattgtttgttcctatgtggagaggatttcttaactctttcttcatctggctgctagagcctctagcctgaatatttagtcacttcctgaactaagtataattattgatttgccaaccatttaacaccagctgattctaaaaacactgctgtggggatataaagatgaagaagatacggatctgtcttaaagagctgagagcatagtgaggaagatagaagatatatacttaccttatattaggctcttggaatttgtggatttttttcccccgtttttggcttgggatgaatcctaaaggtctgttgcatattacctgtgattttgctaagatacaaactttaaggtagttagatggccattgaatcaagcagtgaactgaagaaacataatgcttcctataaggagcagttttgatataaaattggatgaattttgtaaagagcaagatgtaatattaaatcaaagttattataagctttggtgtatagttaggctgttggccaaagctcacattgctcttttattccatagcccactttttttgtgggagctaggctttcagtccttaaagtgactttctacttttttccttttctcttttccttctacccttgcagggctctcataagtgcctttgcatggtgtcacagttagatgaaaattgcctgtattttttttttatgtctttgatctgggcatcccgagggtgcctctgtaagtgtgctgagacacaactgtgtagtggtaaccaaacctaattgcccagcagaattaactcaaaggagggtttttaaaaaaagttgaattgaaatataattcatgtaccatacgcttcacccatttaaagtgtacagttcagtggcttttactatgttcatagagtattaccactgtcaccacagtcagttttagaagattttcatcactccatgaggaatttcttacctattagcagttactccccattttacccaaacctctcagccttggcaaccgctaatctgtctctgtaggtttgcctcttctttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgccttggcctcccaaagtgctgggattacaggcgtgagccaccgcgcccggccggtttgcctcttctgaacatttcacataaatggaatcatgtagtatgtggtcttttgtgactggcttctttcatttagcaaggttttcaaggttcatctgtgttatagcatgtatcagtattttatccgaggactatgattttttgattgcttactgtaaacctatggaataaaaatctctgggaacaaggcctggaaataattctttttttttttttcctgagacagtcttactctgtcgcccaggctggagtgcagtggcgtgatctcggctcactgcaagctccgcctcccgggttcacgccattctcctccctcagcctccccagtagctgggactacaggcgcccgccaccagggccggctaattttttttttttttttttttgtatttttagtagagacggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagcttgtccctgttctcctatggccacttaaatccagaccttttcatctaaaatgcaaatatgtttggcatttttcatacacattcctgtcttttttcccccttctgctgtcttatgtagatactgagaatattaaacctgtactcttttcatttgctacataagcacccgttttgttgtccagctgtattttttgggttggagggttaggtctgcaataatcatgttatttcccctttgggtatacaaatgagacaacgtgagcaaatacaatctgtatttttaaagtgatggaaataacttaaatttttttttcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtaagttatatgtttcagaggaaatggtctccgtcttaattattataaattgcccataatcttattacccagaaataacgacttaatattttcctgtattccttttgtgtgtgggttgggctggggggagtttgaatgtggtgctgtaggggtggcatgtattttttgttgttgttgttgtttttgagaccaagttttgctcttgtcgcccatgctggagtgcagtggtgcgatctcggctcactgtaacctctgcctcccgggttcaagtaattctactgcctcagtctcccaagtagcgggattacaaatgcccaccaccacgcccggctaattttttgtatttttagtagagacggggtttcatcatgttggtcaggctggtctcaaactcctgacctcaggtgatccacctgccttggcctcccaaagtgctgggattacaggagtgagccaccgcgaccagccttgttgtattttgagacagggtctcgctgtgtcacctgggctggagtgtagtggcgtgatcgtaggtcactgctgccttgaacttctgggctcaagggattctcttgcctcagcctcctgagtagctggtaccataggcacatgccactcggcccagataattttttttttaattggtagagacagggtctccctttgttgcccaggctagtctccaactcctaggctcaagtgatcctcctgcctaagccccgcaaagtgttgggattaggcctggcacagtggctcatatctgtaatcccagcactttgggaggccgaggcgggcagatcacctgagatcaggagttcgagaccatcctggccaacatggtgaaaccccatctctactaaaaatacaaaaattatccgggggtggtggcatgtgcctgtagtccctactcaggaggctgaggcaggagaatcgctccaacccgggaggtggaggttgcagtgagccaagatcacactgctgcactacagcctgggcgacagagcgagacttcgtctcaaaaacaaaagtgttggaattataggcatgagccactgcatctgaccatatttttcatctaaatggttgtttatgtatgatttatcttgcttccttcatgaattctctcccatagtctctgtattaaaactataaatatcacttttattggcaatataatcttttttatgaagtagtcataatttgcttgcaactttctgttattgggcatccaagttttctcaacttttccactgttaataatcatactctgataaaaacttcaacaaaaagtgtcttcattgcaagttatttccatagagatacctaaaaacagaattactgagacaaaggacatgaacatctttaagtcttgcaaattgccaaaatgacagaaagattatacctcttcatgcttccagaagcgcataaccttttcttttcttttcttttcttttttttgagacagagtctcgctccgtcacccaggctggagcgcagtggtgcaatctcggctcactgcaacttccgcctgccaggttcaagcaattgtcttgcctcagcctcccaagtagctgggactataggcatgtgacaccatgctcggctaattttttgtatttttagtagagacggagtttcaccatgctggccaggctggtctcgaactcctgactgcacataaccttttcaatattgactttcttgtagaaaaacagatttctttactgtaccgatggattaatatagtggtgttccattgctttaatgacttaaaggaaaacccattgttttggggtttcttattaggttaggtgttctttatttggcttttgtcagttgattttggtttattgagttctagtcagtgtcattttttaagatggacttaaacattcttcatcactactatttttattaaaatttctagaaataatcaagtgagaatgcatttaataagaacatgagattttgcctaacatagaattccctccagctttgatatagaaaagcagttatataattaagatatatataatgtgaattgtttatgttggcaaaactaatggcacaaagaaaaatttcaaacccttaagccaatttttttattttatttcaggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtaagcaaagattttaacaaattaaatattctgaattttgtttaatttttttttctaacttaacttttccttaaataaaacaggtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagcgctgaactgtgtatttagaaaacaattttagtaaattgaagtattttttagacctggaaactcagcagaattgagacttgtagttcagcatgaaataaacactctaagagcccaggaaaaacatggccttcaacctgctctgcttgtacattgggcaaaatgccttcagaaaatggtgagttttaaagtataagcatttttaaagaacattaccttaattttttaaaatcatgcactttttattgaaagtttttttgttcagaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctaaatatttaaggtttgttttgtgtcaccattaggtgaagatggtcagccttttgaacaaactgacactacagaagaggcaggtttcagctatctaaaaatggcaactgttaaaaagtagttgggattgctacattagggtggtatcattagaagtgtttaaaagttgagtgtagaggccgggtgcggtggctcacatctgtaatcccagcacgttaggaggccgaggcgggcagatcacaagatcaggagatcgagatcattcctggctaacacggtgaaaccccgtctctactaaaaatacaaaaaaaaactctactaaaactacaaaattagccagacatggtggcaggtgcctgtaatcccagctacttgggaagctgaggcaggagaattgcttgaacctgcacggcagaggttgcagtgagttcactggtattaaggtggtttagttattacagtatttggaagttgaacaaatgactattgaggtaccatttggttttgacttgaaattttagccagttcttacaacctgtaaatgaactttagatctaatcatgcgtgttccttaaagttgtgtgcttttaactttcttttttagggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggtaacagagttcctttatgaatttattggagatgggaatttccagtttataaacaaagacgtggagctataaactgcttaaattaattgccttgttatttaacggtaatcttgttttctaaattcactagctctcacagataagatatgacagagaagagtaatgagatgtttgtctcttaagatcatataaaatctttggaaaatcatttgggttttatattctgagtataaacaatttgactaaaaactattctgtgtgtttaggcatcagaaattgttgagtatgaagaagatgcacacataacttttgctatattggatgcagtacatggaaatatagaagatgctgtgactgcttttgaatctataaaaagtgttgtttcttattggaatcttgcactggtaagtagatgcagtacttgagctaaaagttttatttatttatttattatttcttttaaaagacggggtttctctgttggccaggctagagtgcagtggcacaatcttggctcactgcaacctctgcttcccaggctcaagcgattcttgtgcctcagctcccgagtagctgggattacaggcatgagccaccatgcgtggccaagctgaaagttttttgttttaaaaagctaatgatttcataaaagcactatttgtatagatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcagtgtttttgcgttggtcttatattttggtaatttcaaaaatactcagtaatatgttgttattaatgcacagaagggatgtgtgtgtctaaatgcttatatttgcttgctttgtcttaggtttggtgtgtctttttaaacttgggaatctaggtgttatcttagcagtgtaatcaaaacaaatattataacctcaggactaattcttaatgaactttgctgaaattgaaagttgttgctgacaacttaagagcatttcttctcatcctcatcagccattatgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatagaataaagacaaaaaaataaaaataataatacaaaacagcagaaaaacaaagaaaaaagataattaaaaaacactttcacgtgtattattatttaaagtgtaaagtgcttattaaaatgacaaaaatgtaaataagataaaatatatcattttagagtttttacttttggaattttttgcaaatgaaagcccttaattaatgtcttttatttttagttgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaaggtaaacaggaaagaatggaatcatttcattgtgaaattgtttctaagtgttttaaatgctcttttgttatttttatttttttttttagtattctcccaaaacaccacctcgatgggcagaagatcagaattctttacggaaaatgatttgccaagaagtaaaggccattacggtaagtcacttaatttctctagctgtactttttattccaagattccttccctggccactctctcactttttttctgaagctggtcagaatgtccccttgccatccaaatagtatggcaaggggacattttggtctttttttttttttttttttaaggcagggtcttgttgtgcaggctgcagtacagtggtatgatcacagcttactgtggcttcgacctcctagctcaagagagcctcttggcttagcctgccacgaagccaggactacagagagtcacacgccactaggcccagctaattgtattttttgtagagatgggatttttccatgttgcccagggtggccttgaactcctggctcaaacaatcctcctgcttcagcctcccaaagtgctgggattgcaggtgtgagccactgtgcccagcctacataccttggtcttgaccctttaccatattttgttttgttttgttttgagatggagtctcactctgttgcccagtctggagtgcaatggtgcgatcttggctcactgcaacctccacctcccaggttcaagcgactctcctgcctcagcctcctgagtagctgggattacaggcacccgccaccaggaccagctaatttttgtatttttagtagacacagagtttcaccatgttggccaggctggttttgaacttctgacctcaggcgatctgcccaccttggcctcccaaagtgctgggattacaggtgtaaaccaccacacccagccctttactatatttttgaaagtactttatgtgtctctctcctcatcttccacaaaatttgagaccttcaaaggtagaaactgttttatttaaaatataagagttcctgacacagagaaggttcccgagtgattgaactgctacagtgtactaatcatactctggtctatgagttcattctcagattagctgtggattacatgtgtttcaaatgtatagctaggaattgaaaagtggtctgagcttcaaaaagtcttgctatattttaatacttccatatgaatttgacttaattatgtaaggaaatagttatgtatatatatcttattttaacaatagggttcaaaggagcttgacttttttggaattggaaataaaagtaggttctttcatgtttatcaggcaagaactaaattatactgctaaagttacatcaaggatatgctgatgtgtggcgattattacagtgtgatcagcagtatttgcaaattgagagaatactatttggtggggaagacatttttgaatttgcacaaaaatcttgaatgttaattctgtgtagtcatggcctatgacaattacatacaattttgacttaacatacaggtttcaggctcccaacattgtattctgtggaagtatagtggagcactagtccatgagcttgaaaagcttggtactagtactgactctgccattaattaatgatcttgggccagtcacttccttcgtgactggcttcttatctttaaaatgagagaattattgaagccagttctcattacactgaatgttaaaaattacagttacagcagtgattgcaaattcaaagctctggtgcggataccaacagtgaccataaagttttctaggtgattccactagtttcttatttcttggatgtgtatgtgtagcatctggactaggcactgtagatggatgagtgggggaaattttatttagcttgaaaattgagatagttttggacctcatggttaggtctttctgggaaatttttatttgaaacacttgtagaaaaagaaagcagacatgctagatctgtccctgacctcacttgttagaactggtcggattcctgggctgatacagagaagtttgaaacttttcaaaatttacctgttttctgataccactacaatttctttggaaaaagaatttcctgttaagtgtctgttttgtaaggggacattttgtaggttctagggttgggtatggtgctgtcatttagttttcttcagcagagatcaggtagccacatagctacactagatggcattgtatctatctgccatcttgtcaaggcagcagagttgtgttaagagaacatttttggagtcagatgtggttcaaattccagctgttattccctgcatccctttctctcattttaagataggagctaatattgtttacctaacagtgtagatagtataaaaattaagagtttaagtgcattggacgtattattatatacataataaattatctgcagctactgcttttttccctttcctggtggagcatttgaacgtcacctggagaattagttgtattttgtttcagcatggggttaagtgaaaagctaatttggggaggtgatttggaatgtcaggtagtccagattgcagtatagaaagaacacactgaaaggatggtcagtgtaatgttagaggactgtgaaagttggggaaagaagtttagtttgtaggtacttgtttttttgagcagggaattgtcttggctggaggtgaatgtcagaaaggttaatgtaggcaagtgtagaatggaaatgaaggtgtgatcatttaggaggttatttgtttaggtgagagagttaatgaattaggttttgtattaacgaatgaaaatgggagcagataaatttttaacaaattaagaatcatattttaaaatcagcaccaggtacctagaactcattggcaaatagaaactttcaaaagatataatcaggtccgggcgtggtgggtcacacctataatcccagcactttgggaggctgaggtgttggatcacttgaggtcaggagttcaagactagcctggcaaacatggtgaaaccccatctctactattatacaaaaaattagccgggtgtgctggctgacgcctgtaatcccagctactcgggaggctgaggtgggagaattgcttgagcccaggaggtggaggttgcggtgagccaagattgtgccattgcactccagcctggatgacagatcgagacaccatctcaaaaaagaaaaaaagaaaaaatcagttatttaaatttaaaagagtaagtttccccagcactgtttctggcatgatataattaaatgattaaaattatttgatttttttttcttccaatagaaactaaatagcagtaagtcagcatcccgtcatcgttggcccacagagaattatggaccagactcggtgcctgatggatatcaggggtcacagacatttcatggggctccactaacaggtgagctggcaagtgcataatcgcatattttagtaaaactactttacttccctcttttaagtagataacgtgtgaaatcaccttgtttatatatgtttgttaatatacatgtcaacgtctgtttatatgtgacttcaaaagctgtatttggtgttacggagatttttataatcccaagcagaaaaaacgagccgtatgtgatcacgtgtatataaaggcttaaagaacacttaatccacacctcagatgagctgagatgagattattccttaaattgaaaaatgttattgaatagagttatgcactaagaaatgcttaattaagaacctacacctctggggaattattttgatgataatgatgagaggcaggacgttatataggaaatcttacttaatttgaaatattatggttatataaagaaagaaaaggagtttggacctgaatcatacagggtttttaagttctgctctatcacttactataatagctgtgtaagttaacctgtctgaaatgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaatttgatttaattacagtaacttagaatggccggtaccattattaatcccttttttataaataaggaaatggataaagaaaggttaggtaacttactcattattatacagctagttattgatagagccgagattcacactccagtggtgtaactccaaagcacttgccagtataatacattgctcccaggcagccagaaataaaaaaattgttccttttacgtacgacagacttctgaaatggtagtagtagtgcccttttttttttctctttttagcccaggaaagatttagaataaaatctagtttagatgagcacatttgtgtgatggttcctatagttaaggcaaccccactagccttttgtgatagtatcttctcaacacaagcaaaataacagaaaatctttgtgaagtcaagcttattaaatgtcgtaagtcatagataagtatatgaaatgtctaacgttcaaaccttgttttcttaaaaccttacacatcatataggtccttgtaagaggataaacaaaccggctagcctttcctggggcttttttagtgacgtgtgcagtcagttatttggtgccttgtgggtcatgatttccatttcttctgtgtacaggcataaaaggtcttctgttcttatacaagcatgtaaatccaacattctcattgtctcattttattcttgcaatgaccctgtgaaatgtgtagaagcagcatatcctcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaagatggtccttgtttttttaaaataagatgattaaaattaaagattaatgagctcataggagatactcagaagtactgaacagggtgaagaaaactaaaaactaaccaccttattaacatttcttatatttgagagcatttccttctggttctttctctatacatatagtattttttatgagattgttaccatgttactatgttgtgtgtagatgagctagcctgttttttaaatgttactttagttctgagcatttttaaacttaaatgttttttgaatattaatgagttcatggtgtcccatcacatggaagtactgtaaattctgttcctttatttatgttgtttctggtttatgccattacaaattctaggacactgtcctagttttgtagggtattcaaaatattcagtttatgctcttaccactagtatctgatagtgccattttcgcacttttgctaatgctgacttactagtttataaaatcctttgccaatttgtaggaacaaaagttatatcaatttttaagtttttttaatactagtcatgctcaacaattcatgcaaatggcagttggtagttttgccatcttcaacgtgggtaccttccagttgtttggtttcttggtaaaactcacacaaaacagatggagaagagtttttgtatatcaacatgaatgttaatgtgatttttttaaagccaacgaacacatttgtgttccttgtgagatcctgtgcatgaatttgtcaggtaatttttttgacttgaacattctcataatagcttcaatttgcacaatgcaaccttgtcattttgcagattttcaaggctcacttcaaaaacatgttccttgaggcctattaacatttctttcctaaattgtctattcatatggtgctttaaaaaattagattacttttagtatatttattagagcctcacagtttagagtcagtagtcaattaaagtccctacttaaacttcagactaagattttttttttatttaatattttattttttctttttgctttcatgcagacagacattttgcaagactttaagattcttgggccatttctgtcaggttgttctgtgttctgtgcctgcttcctccccatagtaatttcaaaatagttatcctcacctctgtaaggtttccaaaatcaaacttgggcttctggctagccttttctaggtcttgatttttcagtgctttccagaggcaattgtttggaacctcttcgcacagtttctgtttcttcttccatgtacaggcataaaaggtcttttggttgttttctggtaaaactatcataaaacagttcaagcaaatgactattggtagttttgtcattaacatgggtgccttctagtcgttttgtttcctggtaaaacagaccaaacagagggagcagacagtttgtacatctgtatgagtgttgatgtgctttttattttaagccagggaacacattttatgttatttatgacatcctttccatgaatttgtcaggtgatttttgagctgaacattctcagtaatagctttagtttacaaaatacaacctagtctttctgcagattttctaggcccacttcaaatgcattgaccatcagatggcatcttggttccttacgtcctttctgtgactgaatgtccataattccacatcatactgatctttcttagaaaaggcaacagttactttctcctttattccttttttaatgcttgtgaggtagttcttgttgatcacagcgatgctattctcttattcttcatgtcatatttagcaatttttttctagtttgtcatttgataatcttgattggtatattttgatgtacagaaatttaaaatttatgtagttaaatctttctttaatttctattgcttttgtatttatagctcttgcctagatagtcttaactgtagtatagactttaacagtgttttctttcttttcttttttttttttttagttgcaactactggcccttcagtatattatagtcagtcaccagcatataattcccagtatcttctcagaccagcagctaatgttactcccacaaaggtaacaaaggaataatttatacatttataattattttctttttaaattgtttagggttccttcaaataaattcaagagagcagttcactattaaaacttttatgtcccttaaaatgtagatattttaaatttatctccaaatacagaaattatccttcttagtcaccttatttttgtgttaataagtgtgaatatttagaatattttaaaaatgggagtggtggtggtggatccttcatcgttctgttttaacagaaatagaactgtaatgcccttgctgacccactatgtggtaagtactttcaggcctgatacagctatatatataacaattgattgaagactcaatattacagtggtagttgaatgtgacagctttgaggacagagtgttggggtgcatttagacccttgttcttctgcttattttgaccacaggcaagtttcttaacctctcaatgcatcagttgcctcatatgtgaaatgagggtaataataataccttaattcatagggtttttgaggatattaaaatgagataataatgtaaagtgcttagaacagtgcccagctgacacattaataaatgctcaataaatgttatcatcatcatcatcatcattattgttaacatcatttgataaattgtttaggaatgaagaaggtatttatttcatgactattttgggcatgtggatcaagaaaattcaccttcatttatgtttcagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaagggtaggtactttgttgttaaagttaagcacaatttttctttcttttaatgtttagcttgatgcagactctttgtgggatactaatgttgggatataaacgatgctttgtgaacacccccaaaatatttgagcaattttttttctcccttaataagttcacggtgaggtttcaaagagcaagagaacttagttaaagacatttcagtaactggaagatacttctatcatgctagggcagagcaaaagaacttggtacagtgtatggactcatgcttgaatcatgcgcattaacgtgagtctttttttaaagtgttcattttcatttgttctgtttcttttgtcactcagaaaacatgatattgaggctgggcacggtggctcactcctagaatgccagcactttgggaggttgaggtgggcagatcacttgagctcaggagttcgagaccagcctggccaacgtggtgaaaccctgtttctactgaaaatacaaaaatgagccgggcgtggtggtgcgtgcctataattagcagctactcaggaggttgaggcaggtggatcgcttgagcacaggagatggaggtagcagtgagctgaagtcatgccactgcactccagcctgactgagtgagactttgtctccaaaaaaaaaaaaaaaaaacaaaaaaacaaaaaaaaccatgatattgagatgttctcattttatgtgttgtatgtcagtcttgctcatgtattaaatgagcaaagaatgaaactacagggataaatgaatatgtaagacagtcagattggtggtataaattgagggattctggctttttatgttttaaaagcatattcattttgtttcctaaaatgttaaaaaatgaaatattctttattttctaggatttaattttagcctttttaaatctaatcccatggccttttggactagcaccccttcctcacagcctgagagcaaaggtatagaactagcattctcagtatgagataacagcagtttttagcagctggtagcccttaggaaagtattaataactgtggctgtatgaaatgaagtacttaccactacaacatgaatgttaaagaatgccagtttaagcaaagtaccttttgactggtggcatgacacccttgttggtttgttttttaaaatgtactgggatgctgatttgtaatgtacttcattgctctgctatttcaggtctgctcagtgaagacctatgttttatctaatgtttatctttagccactaacgtctgccagtattcacatgtagtggcaacggcatgtatacagtatggaagagtgtccctgtagggctgttcttttgtgcatggtttagaaaaatgttgtatttgaaaatggaccccatttttaacagccagcattctacagcttgcatattatatatgttgcacagatcatttttagaagtgtggctactagagtggaacaagaagtgggatctgttgaaggccttcaagaacaggttagggaagtgaaacctcacccttagtgaccagtaacacatcttagccatgccaaacaagtacaatgataaaataacaatctctgatttttttttgagtataccagttttattaccagctaaggtagctcttaatcttttattttaaagatacggtctttgagaaatgtgaaaagtgttaacttaaaagtggatgtatacttgcgtacagtttctgtgagctctaggttaggaatccctgacctaagaacgaatgtgcctatacactactgtagaacatagagccttattctgttttgaatctgataatgtcattgtcccaagggaccttagaaatgaagactttagacatgagtaaactgaggccaagagaggctatctgatttacccaagaggtctttactgagtaatagcagaagtggaacaagaatctgtatcttacggtgtactgttatttctcctagctaggaaatgatactaggttttcgtttataatgaaggagagggacaaatttaacattgtaaaaggaagggcactggttctgcagagcagtgtcatccaatagaaataaaatataacctgtgtatgtaatttaaaattgtcatttggtgcaatggcttgtgcctataatcccagttacttgggaggctgaggcagagggatcacttgagcccacaagttccaggcttcagtgaactatgatcacatcactgcactccagctctgggtgacaaagcaagaccgcatctcaaataaatacataaataaataaattttctagtagccatattaaaaagaataaaaagaaacagttaaaaagggaaacagatgaaagtaactttatcgatagatttgatttaactcattatgtccaaaatatcattttaacttctaattaatataaaaattaatgatattttacattattgtttttcaccaagtcttcaaaatccagtgtgtgtgtttacacttactgttagcatgtcttgatttggactagccaccttgtgaggttttaatagaatgtggctaggctaccatattggacaccatagctctcagaatgtttccctgtcaccagttggtatacatggcatgcttcataactggcttactttattaaactcctttagccagaagttgttctttacattaatagatcagaacaggttgcatatagaagttttttctgtttctaattttttgccctttgcattgatggtggctggggatgggttgttttcagccatatgaatggtcttagattttatagtgttagctacccatagagtaacagtttttatttaattttatctagtatcatgcttgaacacaggcaaactagatgcaactctagtcaccttccattcttggcaattgttaactttccttacaggaactaatcacagttggctttggattagtttcatatgtatactaatacttgcttatgttttaagatttttttcaattgctgcaaatgcatggatattttggtaaactattgtatgctaagtatagttaggcaacactttaaaatttttaacctttttaaattctagaaatttgtagtaattcttttcaatgactattaagtaaacacaagatttttttgttttctttcgttttaaatagattctgtgttcacttagggtttttggtagaaaactaaatcaggatgctaattctaattcatgattatcgtacatctctgcatcaaagtatatgtgttttttatcagtatgctgttttaacctatagataggttccatggtttttattttcaggtagagtattaacgtcaatacttaataccttatctttgtcaatttttttgactggtgttacagcaaaagagaagaaaaaacctgaagattctccctcagatagtctcggtctcctgacctcgtgatccacccgcctcggcctcccaaagtgctgggattacaggcatgagccactgcgcctggctgacacatgtcttaattctggtattcaccagatttgtttcgtgttctccgttgttagtcatcaaatttgtctactttttaaatagaaacattagctagagcaaggaacttagaaacactcaagcagcactgaatgtgtagaattgcataaccaatatagcttctttgctttcatatttacaattagttggagttttagttcagccgtacccagtatcttccattctgcttccaggaagaaatggaaaaatgtcagccatgatgatgcagtattttagtagcaagttgatggtgttttggtttcccatgggaaatattgtcactggagcattagcagctatcggtcacttattagggtaaaaaagcaacttcagaagaatttaacatatgccaaagaatcaacaaaggaagtaatcagccagggcaaaggtcgcacaagagattgtaatctagcaatcagcagtggaataagcagtcagcttaccagaaacccaggaaaatgctttagaaagggcagtcaggactaaggcaatttaatgaaatgcaaaataaatgaaatctgaagtttaaaaatctagattacaattctggtttctaactcagttatgagaccttgggcaaagtcattaaatttctctgaacttcagatttttgggagtcaataaaccaatacatgtcaaagggcccgataaactttacagtttagaccaggcgtggtgtctcacccctgcaatctcagcactttgggaggccaaggcgggtggatcacatgaggccaggagtttgagaccagtctgaacaacatggtgaaatcccatctctattaaaagtacaaaaattatctgggcgggatggcatgcacctggaagtcccagctacttgtggggctgaggtgggaggatggcttgagcctgggaggcagaggttgctgtgagccaagatcgtgccactgcactccaacctgtgtgacagagtgagaccctgtttcagaaaaaatatagtttatcagcaaacaggaaagtcttgctaggcaacgtaattgattagttctgtgccctggattctgggctcttaactgtatgagcactgtaggtgtgagcagcaacaattaagaagctgcagaggtaaaggtataagggcagtgattgaggatgtctaccaagcagatttcggcaagtgtgtttcaagaagtatgccgcaatctgaaatacctaatcctgaaaaattgctagaatctagtcttttaattttggccagtatttagcagtagtttggccctctactctaaattaataaaaaataagtagtactatattatgagctgtgttatctaacagtttatcttagctagtagcaattaatttatagctgctattaaaatgactaacgtagttaaaagtttgatgactaagtttttttttgtttgtttgtttgtttttttgagctggagtctcgctctgtcgccaggctggagtgcagtggcatgatcttggctcactgcaacctccgcctcctggcttccagcaattctctgcctcagcctccccagcagctgggattacaggcacctgccaccgtgcctggctaatttttgtatttttagtagagatagggtttcaccatcttggccaggctggtcttgaacttgctgacctcgtgatccacccaccttagcctcccaaactgctaggattacagatttgagccaccacgcctggccttgatgactaaattttaggaaatgttttagcaattcttcatacacctttcacttatagttacttaattcctctactcttatcatttgatattttcattttattgtgtatctctgtaaggccgaatcaatagattttgaacaatctcacacttaacctttaaaaaaaatctaataggcccagtttcctctcagcaatctttgaagaaccttcgagaaaggagaaacacagacctcccgcttctagacatgcacactgtaacccgggaagagggagaaggcatggagacaactgattacggagtctgtgtcttccgccagcacatacacacagtctttagagcagctgcttaattctcccgaaactaaacttggtctgttactctgtctaaatatgttcttcttctttaatttcactgtcttatttaattactattacactaaggtacatatgcttttttgggctgctccaataaaatttctttcaatattccactacctgtttgtattagggttctctagagggacagagctaattggatggttggatggatggatgagatggatggatggatgcttattaagtattaccttacacgatcactaggccatctgcagactgaggagcaacgagagccagtccaagttccaaaactgaagaactaggagtctgatgttcaagggcaggaagcatccagcacaggagaaagatgtaggttgggaggctaggccagtctcgccttttcaggtttttctgcctgctttatattcgctggcagctgattagatggcacctaccaggttaagggtgggtctgccttccccagcccactgactcaaatgttaatctcctttggcaacaccctcacagacaacactcaggattaatactttgcatcctttaatccaatcaagttgacacccagtattaaccatcacactgtccaaatggaaaaattattaaacaaatcttttttaaaataaaatgctagctcttgccctaggcttgaaccataaataagtggtgggaagtttatagtcacaaataggtggtgggtattagaaagcaggataaactatcctctcacccttccaagaaactgacagtttcagtttattcctcttgatgaagtaatgctaaatttttgtagtgatgttttggtatattttattacctgtaattaatattactgttcaaaatttagggggaatctgtcatcttcctgaaacttcagaatcacctggagtaagggtcatttgtattcatggtcactgaccacatggggtagaaactgcaagtcatggttccttcaggcaaagttaatagtggtgacacggaggcatcatgatagagcagcagactccagaagccaatttgactttgtgatttctgaaaaaattacctgtcaactgtgagcctgtttcattgtctgtaaagtttgaataatgatacctaccccgcctgatagaagattcttatgagggaacatgatacgtgaccagtaaatgttaatgctttccttatacgtgaaatgacataaaatcttggaatattaatagatgggaagaagatgtgtaataaaactgtctataaacacaattctgacaaatttcagaactgggactcatagggcttgtattcagttagattacatgctttacaacagagatactgttttatttgtgtcacctacaacatataatctgttgattgaggtatgttgaatagatgaatggcaaagaaagcagacctataaaatatcacatagtaagatatttatatttagatttttcttatttagaatcttcatctgtaatgtatgattttgaaaattaattcttggaacaacatgttgcagagcctccattatggcatgctgaatttaccaaagaagaattggttcagaagctcagttccaccacaaaaagtgcagatcagttaaacggcctgcttcgggaaacagaggcaaccagtgcagtccttatggagcaaattaaggtgagatcagaaacctggccactgtgaaaaccgccagtttggttttctggaccctccatacacatgcacccaagtttaaaaattcacattgcagatgcatctataacgtcttgatctttatattagattattagattcctgatggtgagaaataaatattgccttttttttttttttttttttttttttttgagacagtcttgctctgtcacccaggctggagtgcagtggcacgatctcggctcactgcaagctccacctcccaggttcacgccattctcctgcctcagcctcccgagtagctgggactacaggtgcccgccaacatgcctggctaatttctttgtatttttagtagagacagggtttaccatgttagccaggatggtctcgatctcctgacctcgtgatccacctgccttggcctcccaaagtgtgggtattacaggcaagagccaccgcatccagccaaaatacttcttttacacctattacataaagattatttcttaattcctacttttcctaagaaaccgtaatagatttagaaactagagagatgttcacaaatcattgttcacatatgcttaaataaaaaatgggtgtgagtctttgaattctaaagataaccagtgaatttaaattattcaactgatatttatagtactgaactactaaacagttttcaggtggagatggcaaagtggcatgggaagtttttcctgtttaaagtagacaccagaaacatctaggaatgttgcagaacagttgaggattactcaaatgaggtatttccaccctggctcactgataaatcacccctcagaatatagtcatactgcttattgaggagttcttatgacccaggccctgggctctacatacattatttaatctcatcactggttgagagaaaaattgaagctggtaaatggtggaacaaaattcaaactcatagctgtctgaaaagtacatgcttttcccctgtactttgctgttcctagtagatctgtcctgccactgtgcaaggccactagctatccttgtcagattattttaaagccgaattcagttattttcagtaaattgtatatatcatgacattccaccattaaatacttcagtatgcatctctataaaatagcattttcccactaataaaaacattatcatagctaacaaatcactaactagcccagtaaacctaaatgacttatttaaatgttatattttcttttttttttttttttgagatagtcttgctctgtcaccaggtttggagtgcagtggtgcaatctcagctcactgcaatctccgcctcccaggttcaagcgattcccctgcctcagcctcccgagtagctgggactgcaggcacgcaccaccatgcccggctaattttttttattttactagagacacggtttcaccatgttggccaggacggtctgaatctcctgacctcatgatctgcctgcctcagcctcccaaagtgttgggattacaggcatgagccaccacgcctggccaaatgttatattttcataaatttatactctcttcatgatttctttgtcttctttattgtcacttttttaaatggtcctaggtttgaggacaaagttcgctaactttcttgcctaacctaaaatgaaaatatactaaaagctatggcttggtttcaacctggaaatcttcctcaaagacttgaacatgatactaccttttttatatcgttctttgcctcatttctctgatagtgttttacattgtcttatattcctgaattttcactgtgtctgaactttttaagtgccgttcactgtggacgtcttaactgcctgggacttcaggaacagcgtaggggcagggggttagtggaggctaccgatgttcccctcagcccattttcagagccccatgccatactggcttagtttctatcaaaagtagaaggcagagggaacatcttggtaccaacccatggctccagttagttgctcctcatggagacgttccatcagttccccagctttcaactccatttccatgataccctgtgcttctgagacaagaactccagtatttacacaggatgcatcctctcctcttgtcagtgatacttggtaagctgctggactgactcatttccacctcttcatctgtttctcgtgagaatgtcttgacgttatctcatctactttttctcctcttgtattagcttgttgcttttctacttcacccctcttccttccaaccccaaatagcttaggacaatggagtcatatagcccaacacttggttcatatgcagcaatccactttctaggcaaatgcagctttgaaactatctcatagttggagttccggttttcatgtcaaatggattttatacggtgatgtcataaactcctttgaaatgcttcacatgcagctgctgtagttaactgaattccttcctttattgccatatggagggaagggggaaatttggggggaagagaagaaaaatacatgagttcagtctgccatatttaatcagaagctcctaaagcccatttttaactcatttctctaacaccagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtgggtaaaaggagagtctcagaacttctgacttctaacttaaactaaacagcctggtggttgagaagttgtctgtatgtgtaacttttcaattttgctcatttgaattgggtctgtcatatgagtaggccgtgactagatttgaaaagctgactttttaacatcttgaggcaactgtagtacatttatataattttaacattcagcaaaatacaataagtgcttagcttgatcttctagctctttgaaaattggatttttatcctggtgttgagttctggtgttcagctgaacgtggttttgttttaaattctactttttaaaaaacatttattagcttgttccttttctacttcacccctcttccttcctccaaccccaaatagcctaagacaatggagtcatatagcccaacacttggtctatatacagcagtccactttctaggcaaatgcagttttaaaactgtgccataggccaggcactggtggttcatgcctataatcccaccactttgggaggccgaggcaggcggatcacaagatcaagatactgagactatcctggccaacatggtgaaatctcgtctctactaaaaatacaaaaattagctggacgtggtggcatgtgcctgtagtcccagctactcaggaggctgaggcaggagagtcgcttgaactcacgaggtggaggttgcagtgatctgtcacgccactgtactccagcctgacggcagagcgagactcccatctcaaaaaaaaaaaaaaaaaaaaaaaaaaaaaaaaaaaaaaaaaaaaaaaaaaaaactatgatgtagttagagttggtttccatgtcagatggatttaatactgtgatgtcattaacttctttgaaatgcttcatatacaactgctatagttaactgaattcaagctgcatcttaagaattatggtttcatttttgttttagttttaaattacttttatttttgacatttacaagcacaaggaagacgctataatctctcttgagttgtcacccatctctaacggttttcaactcatggacaatcttttggcgtaaataggggagagttagagacttaaatcccacacatcatttctttccccagtgaataattcaatgtttattggatttctctgtcacctatacctagtttatgttcattttgcctgtgttattgtgaatgtctttttatagtatcctaaatagggctcatatattgcatttggttgatgttccttaagctttattttgttgttgtgtttttgtttgtttgagacgtagtgttgctctgtcaccctggctggagtgcagtggtccgatcatggctcactgcaacctccgcctcccggattcaagcgattctcctgcgtcagcctcccaagtagctgggactacagatgcacgccagctaatttttctatttttagtagagacgaggtttcaccatgttggccaggatggtctcaatctcctgaccttgtcatctgcccgccttggcctcccaaagtgctgggattacaggtgtgagccaccacgcccggccattttgttttttttatctataacaattacatatataaatatatttttaatgtgccacttattaattgaagaaagtggtcatttatgctatagcagtcctatatttggtttttaatcattacagggtaacactgagcttgttctaattgcctataaataggaagatccaggtgcaattgggtgggatggtggacaaaaatacaccatagatggtattgtgtgctttctaagacatcaggaggcccagaatgtccagacatcttacttttgactgattgaccttatctagttggtgctctttaacatgttccccatcccctgtaaatcctaataactaaactgataagagtcatcctcaaaattgagcaggcatctgaatcatctggtatacttactaaaattccaattgctggtccccaatttctgacccaagattctgcatttttagcaattcgttgctgatacttctggtctggggcccataccttgagaatccctggtctagaggcctgataagattcaggcttaattttttttacagacatacttcataagtagtattgatagtttctttgaatctggtttttaataatctttctaatgatgaaggaggaatgttctcaatactgacagtaatctcagttcttcaaactataggataggtttctatagccacaatagtatttttgtcacaagggcccaaataagaatacatcatgtatatttttagtagttattcaaattacaggttcactgtctttaatttattctaacaaaagtaaacctaattttatagttataaaaaagaagaaatctacttctagtcacctaagagtaaaactgcccctataaaaaacaagacagaaatctcaaaattataactaattttatagttataaaattaaccaggactttaagaatgtttgcattttaaaattaaagttttcaatacaacaatgatattatctcaaaatactcagcatgtctaacaggtctcttttaaaagctcagcatgtttaatgtagacgttgctaacgtccaggtggctcctataagttaagggtccattgatttagaagttctaaaagagactaacctaagggataccaagaacagatatttttaaagaatttcatagaggagatacacattagaaacccagaactctaagatgtgcatttggtaagtcctgtaaacagacaggaaaacacatttaaattagtttgccctttaaagattatttcctacttgtctcttatcaatgtgagtacataaaagagaccttattacaattaaaaactgatggtttagcagcagatttagataccttacattttctctttaagagagagaatgtaaggcctggcacggtggctcacacctgtaatccagcactttgggaggctgaggagggtagatcacctgaggtcaggagttcgagaccagcctggccaacatggtgaaaccccgtctctactcagaatacaaaaattagctgggcgtggtggtgcatgcctgtaatcccagctacttgggaggctgaggtaggagaactgcttgaacccaggaggcagaggttgcagtgagccaagatggtgccattgcactccagcccgagcaacaagagcaaaactcttatctcaaaaaaaaaaaaaaaaaaaaaaaaatgtaaactacaagatagttcaaaagaaattacacagaattcagcatgggagaaacaaaaaacaagagtgggaaaagacatcaaacatgtttttactaatcgaagttctaaaaggagagacaagaatacagcacagataatatatgaagagaatggctggaaatctttcagaactgttgaaggatatctatccacagattcaaaaacccaataaaatctcaagcaatattaaaaaaaaaagaagaaatctacttctagtcacataagagtaaaactgcccctaaaaaagacagagagaaatctcaaaagcagccagagaaagaagacacattgcctcacaatagacttctcaacagcattggtgtaatactatctcatgtactaaaagaaataactgccaaccttttatattttccaagatctcttctggaaaacaaaaactttaagaatctgccttcactgaaaattcttaatgatgtacttcaagcaaaaagaaaatttcctaggtaaaagttctaagatgccagaaagaaagacatgcaaaggaaacttaccaccatattacagatatggactgtcagtctgactggtcacactaggggcatttggttaccaaggccttgaaaataataaccaacactgcatacatgagggatgccagaagaaaggtctgagagccactcttcctggcactgaaggaaacagggcccatcagagcaaacaagtaccttttacctctctccttggaagcaaatgtttataatctctggttttgtgtaaagtttataacagtatttttcattcaggttgctacctattagtggatggtgaaattaatttggtggatcacattcagaatatttttttaaaatcaaaagaatacaagctggggtcagtgactcacagctgtaagcccaaaagtttgggaagaccaggcaggaggattgcttgagaacaggagttcagaatcagcgtgggcaacatggcgagaccctatgtctacaaaaattttaaaatataccagatctggtggcatgtgcccatagtcctagctactcgggaggctaaggcagcaggattctttgttataaggagtttgaggctgcagtcaaacttctggtcgaaatcctggtcatgccactgcatttcagcctgggcaacagagtaaaaccccatctttaaaaaaaaaattaagaaataaaaataatatgtgaaacattagaatatgttgaatctagtaaggataagcaattatttcttgaaactctacatatatacatgagtgttggtaaatacctgactgtatcatcagctctagatataaaatgtttatgatgttggctgtgagttaatgaggaatagttttcctttctgtgggtttgggtgtatttgggaaacattagctaagggggtaaagtaggttacccaactctgaaaagcagcatcaaaatctttataataaacacatactaggggcccaacttaaatttcaagcagatgtcatgagctgctcagagtagcatgttacaactctgcgttataaggtaaaatgacacattgcctcacaatagcctgccagatctgagaacacagcaaaatttttattttgtcaaaaatctcatattcagcttacaccattcatttcaggtgaacatacaacagtgcatttcagtttagggaaatgtttacagtcatctggttctctttattcctgggaacaaggttacctcacttggaacacataaccagtgccaagttgtccatccctaagcaatattgcttccttctactttctagaagttcttcagattgtggaagagaaacttttcagagttctttgccctcattccctcctccagaaattcatgcctttgtataatctcttccccctgagagccagtaggctaacctaatgagttatttttaaccagtagaatacagcaaaaatgatagattacaagagattgtggcttctatcttgctagcggactctctctgtcttctctgcttgcacactttgttgaagcaagctaccatcccagaggcaaggaacacaggccatcagtttagcagccttgaggaactaaattcttccaactaccacataagtttggaagtagattcttctccagtccagccttcagatgagaccccagccatgccaacatcttgattgcagccctgtgagagaccttgaaatagaaccatttctgatctcctgacccacagaaactgtgaaataaatatgtgttaaggtactaagtttgtagtaatttgttacacagcagattgtaaataacacgtagataaaaccagacagaacagaaaaataaaatggctttaaacctagaaagtttccccatgtaaaattttgaaaatgctactctgcctaaggtcaaaccgtcatacatatatacgtatgaaaacacagaaaggtgtctggaagggtaataccaaattaaatctttatccaagaggaatgaaaaccagtattcacacaaaaacctatgcacaaaccttgtgaatatattaaaaaccagtgacttatgcactttaaaaaggtgaattatgtggtatatgaattatatctccaaaacatttaattaaaaacctgtacacaattattcatagaaactttctttaaaattgctaaaaacgaggaagatctcagttatccttcaactggcaaatgaataaacaaactggtacagccatgcaattgaatactgctcagcaataaaaaagaatgcactgccagtacagcaacatggataattctcaaatgcattatgccagttgacagaggtcagactcaaaatactatgtacagtgtgattctacttatatgacactgaaaaaagcagtactataaggacagaaaacaggttagtggttgccaaggagtgggagaagcagccagggagaactttgaggaggtaaaaatgtgccaggccttggtcggtggtggtacataactgtgcatttgtcaagactcagtgctatacgctgaaaagggcaggttttactataagttgtacctcaataaacatgatttttaaatgattaaaactttggtttttgtttgttttggttcagttttaaggtttaccataaatctattggttttagattctaagttgtatataagcttctgttttaaaagaacttttttaaaaatcctcttatcatcaacaatatttagttgtgctggaaattttattttggaattgtttaatagagaaagacaataaataatgttcaagaacagacattgattcataacatcaaagtatattgtgagaagatggtatttcagaatagaggaagaatttcttatgtgctggtaagattgtagataatcatttctgcataattttcatagctggattgctttaataaagccacttaaaggttaagttctagattgcttcatgttgcttatcaatgttttaaagctaaaatagaaaattagctgttaagttggctcaaccggaaattcagtatatcctttaaaaagagaaatttagtaagcagtgtgtctaaagaatgacatatggttgggtacagtggctcgtgactgtaatcccaacactgtgaggctgaagtgggaggatcacttaagcccaggaatttgagaccagcctggaaaacagcccagcccagcccatgcctggctaatttttttttttttttttggattttagtagagacaaggtttcaccatgttgcccagctggtcttgaactcctgagtgcaggcaatccacccacctcaccctcccaaagtgctaggattacaggtatttggttttttgtttggttttcaagcaacctttctcaattttgctatgctcactctttcttcacatgttggtactggctagatacagattttgctttcctattggagactcttttgagagctggctattccctcttgctccttttcttttttctcttccctactttcaagtttcttgctctttttcttaccccataagttaccagaaattcatacccccttgagagggctttttctttgaacttcagtctttagtttcatcaacttttctaaggaaattgatctgttaatgaaagttggcttgcttgacttcagaatatctgtattattcaatgatgtgtttttctggttgctttgtttgagcatagtgtaaatatcacccattgcatagctatggcagtgacataaatctagcagcgtaagatcgagaaaagctagaagtcccaccacagattgtatttcagtgaaagggattcattttaactgcttataaaactaaagaaaacttataaacatggaaaacaattattaaacccaccatatgctcatactgatattaaatggtgtgccagattctagaaagagttaccttttggtaagagcactgcttgttaactatggttggttgctttagatgtctagtgtgtacacaaaagcatgaattttattccttataaccaaagtagaaacctactctgagcaatttgacaaaaggtttacattatttattttagtgtagtttaagattacagtaagatgcaattcccaaagagtgaaatataaggctgggcatggtggatcacgcctgtaatcctaacactttgggaggctgaggcaggtgcatcacctgagatcaggagttcgagaccagcctggccaacatgacgaaaccccatctctactaaaaatacaacaattagccagatgtggtggtgcccacctgtaatcccagctactagggaggctgaggcaggagaatcccttgaacctgggggggtggaggctggagtgagctgagatcatgccattgcactccagcctgggcacactctcaaaaaaaaaaaaagtgcaatataacttttcacaaaatatggaactgtggtagtctagaacaatgtctcaatatacctcctacacgaagtataatagtaaatatctgtatttggtggcataatatgctcttagtataaaccaaaaacacatgctgagcattggacattgtccaatgtttaattcatatgattcattctgagtttctgactgagatcattctttcagactgtgtatttctcctgggatccataaaatatgcagccctaacatgatttcatttttgtttcctttcctggaaaaggagaaatcattcagatcagctttcatattgccttatagacgatgacttcaaaatagttttaaagggactcctttgttctagaactgctctaacacagtagccactagccacatgtggctattgaaagattgaaatgtggttattccaaatcaggatgtacagtaaatataaaatacacaccagatttcaaaggcttacatgaaaaaagtaatgtgaaatatctcactagtagtttttatagtgattacatgttgaaattttaacattgtgaacatattagtttaaataaaatgtattgtgaaaattaatttcatgtttctatttacttttgataaaagtactactagaggctgggtgtggtggctcactcctgtaatcccagcactttgggaggctgaggtgggaggatcacgaggtcaggagaccgagaccatcctggctaacacggtgaaaccccgtctctactaaaaacacaaaaaattagccaggcgtgttggcaggcgcctgtagtcccagctactagggaggctgaggcaggagaatggcgcgaacccgggaggcggagcttgcagtgagctgagatcgtgccactgcactccagcctgggcttcagagcgagactccgtctcagaaaaaaaaacactactagcacatttttaaattacttgtagtgatctcatttgtaacacattacatttcaatcgtatactgcttttctaaagagtcactgctaagccctgaaattaactccaaatacctccctgggatacagtgccaaggaaggggcttccttgaacttcaacctctaaaagtaagcaagaattgagaaatatcttctgctttgaaaaatattcactccccaacgctaatacatcaattacatattatttgggggctaactaagctcctattttaaaatgtaaactgaagaaatcaggccagagtcattcccatcttagtgccaatcatataatcagataattagattgctctttccctaaagcctgtttagtttttttgtttgctggttttgttgttgttgggttttttaatttgtttttgttgttgttgttgttgttgttgttttgagatggatactcactgtgtcacccaggctagagtgcagcggcatgatctctgctcagtgcaacctccaactcctgggttcaagcgattctcctgcctcagcctcctgagtagctgggactgtaggtgcatgccaccacgcccgtctaatttttttgttttttggtttttttgtttgttttgagacagtctcgctgtttcccaggctggagtgcagtggcacgatctcggctcactgcaacctccacttccgaggttcaagcgattctcctgcctcagcctcccaagtagctgggactacaggtgcatggcattatgcctggctaattttttgtatttttagcagagatggggtttcgccatgttggcaaaactggtctcaaacttctggcctcaggtgatccagccgtctcagatcaaagtgctgggattacaggcatgagccaccactcacagctcgctaaggccttttgccaagacaaattagctcttagagaaccacaggattccttttgtaatgtattacaaactaaagtcttacctactcttgaagagtagaaaacatggaaaagttctatgttagcccttagaataattaaaaattcataagctctgaaataaagacaggtaataaaatcattgcgtatgacaaaacaaaagtttaaattggcgtttgtaaactctgcatgaaagccaggtttctcactactagaaaaaaagttataaataaaccaaggagaattccagaatgaatcctgtggtgccaaatatatgttaactacaaggaataacagtgaccttacactggaaacaccttaaccatgggccaaggttaaagatataacagcattctcacaccccttgcatagctacccccaatgttaacataactgttaacaaattatcaaaactaagaaattcgtcttggtatagtatcactaactaaactccagacctcagtcaggttttcccagtctttccttcagtgtccttcctctgtttcaggattcaatccatgatccttgacacttggtactttgtcagatgtcccgctgtatgggtttgtttgatgttttcccatgattagggatagacactgcaagactcagagctactttacaaagaagcctctagggagctccccagagaagacaggggagacaacacaaggacactagaggaaattttagcctctgacatccatgactatatagcaaagagtaaacaaagcctaactcctagccagagaaacacaaaatctcatactaaagccttatttaactcagttcgtttcacccagtacatcatatacagcctcaaacaaaaaattacaaagcatactaaaagacaagaaaccccacagtttgaagagacagagcaagcatcagaaccagactcagatatgaaagaaatatcggaagtatccaaccaggaatttaaaataactaagattaacatgctaggggctctaatgtaaaaatggcataacatgcaagaacagatgggtaatgtaagcaaagagataaaaacactaagaagaaataaagatgaaatactagaaataaaaaacaccataacagaaatgaagaatgcctttgatgggttcatcaaaagaatggatatggccaatgaaagaatcagtgagctcaaagagatgtcaatagatacttcaaaagctgacacacaatgagagaaaagaatgaaaaagaaaaaacagaacaagagtcaagaactgtgagacaattacaaaaggtggaacatggagactttttggaaataccagaaagagaagaaaaagagaaagaaagccaggcatggtggcttacgcctataatgccagcaatttgggaggccgaggcgggcagatcgcaaggtcaggagatcgagaccatcctggctaacacggtgaaaccctgtctctactaaaaatacaaaaaattagcggggcgtggtggcaggcgcctgtagtcccagctactcgggagactgaggcaggagaatggcatgaacctgggaggaggagcttgcagtgagctgagatcgtgccactgcactccagcctgggcaacagagcaagactctgtctcaaaaaaaaaaaaaaaaaagagaaagaaacagaagaaacatttgaagcaacagtgactgaaaattcccccaaattcatgatagataaagctatggtctgaatgtttgtgtctcctcaaaagttatattgaaacttaatcctcaatgtgatagtactgaggtggggcttttgggagtcaatcaggttacgagggctctaccctcaggacagagattagtgcacttatgaaagaagccccagggaattagctagcccctgacaccatgtgaggacaaagccagaatgtgtcatctatgaggaagcagggcctcaccagacactgctagtgccttggtcttggacatcacagcccctagaacggtgagaaataaatttctgttgtttataaactctccagtttatgatatttttgtcacagcagcccaaatgaactaaggtagacataaaggaacagatccaggaagctcaaaatacatcatttcaataatgatctttaaaactttgtttgaaattatactgatcattccgctgactgctgaatgacctggcaccgtctcagggttttagtctggagtttttgtttatgctcatggcctcacggagaacaatattcacctgaagtgacggcgcttctctttttatgttgttgagaagcatgattggctctttttttgcaaaattattcacaaacttaaactttgattcagaattattgaagtaacatggtgaggcagagtaatatgtgacttaaattttatggagtactaaggaaaacgggcagacttaatataaaagtggtgcattggtggtgcttaagggcaaataccgataacatggtgtacaaataaaggatcccgatgattcaaacaggtggaagtgatgggagaactgagttgtcacacagtaccatatccacactgtcacacaaatctcacctttatttattcccttttgcactaacgtagccagaaatgtgaaacgatgacagttttttcagtaggtattttttttttttagtttttatcattgacctttgaggtgcactattaaattgctcagtccattaaaataacggattgctgatttaaaaactggttccttgcttagcttcagcaaaacagcaaagtctaccacattaaatgtatattgtttatttgatttttattgactttgttgtcttattttaactacttaattgcaaatctgtcttggggttaacactgtgtaagagttttaagcataagaagtctgtacttagagtttagatgtagttttatatttgtacatgttgatgtaacattttaataataataattcaggtctgctgggcatggtggctcatgcctgtaatcccagcactttgggaggctgaggcgggcggctcacctgaggtcgagagttcaagaccagcctgaccaacatggagaaaccctgtctctactaaaaatgtaaaattagccaggcatggtggcacatgcatgtaattccagctacttgggaggctgaggtaggagaatcgcttgaacccggaggcggaggttgtggtgagctgagatcgcaccattgcactctagcctgggcaatgagagcaaaattctgtctcagaaaaaaaaaaaaaatcaggttaattctgggatctgagcaaagttttgctcctttccgagaggtgaacacgttacgcaattattaataatatccctgtgggaaggggctttacaacaaattattttacaggtgaagggcagaaatgaaaacattttctagagccactcctgcccttcacactcaggaatgtcgcagtagtcatctctctgttctggatcagtagtatagcaccagggcccctgcgcatcgttgtctggattcctccagtccctctgaggggtgtgtagcaggtgagaatctggggaggatggaagagaagcacttagactatattctaaaaatcagcttgctattagcaaggcagaaggagatgctctcgattcccatctgagattgtcatccaaatgcatttcagctgggtgctgcagcatttgtgtggtcagattttcaatttctctattgataggctgcttctggcacagtagctaatattaccattgctactgtgacagccaagtcttagacagagagccaaaatatttttattgcacagtcaggagaaatataaaggcctcaaaagcctgccatggtcttaattcattccaaacacctgcttttgtcagttgcccttttctctgtaaaaattttcgtagttaacaccattttgtccatgtgaactatgtgccaggaattccactaacatctttccacacattctctcttttagtcctaataaaaaaaaccatttgaggaaggtgttattatccctgttttacagatgagaagactgagtggcaacgtaaaacaaaacaaaacaaaacttgcctaagcataaatagctatgaagaagcagatcaagaagtcaaagttgatctgtctgattccaaagtcctggttttctctgaaatgcagcttgaattattggggatggaggagggatttaaacttattttcagttctagagatgagttgctgtatagagacaaccatttagatgacaatcacaagacttacagtctagaaaggcaggttttatttctggttcttctgtgaacctatttgggtaacccccaccccccaagacctcagttccctcatgaagatgagcctagactacctcataaaaatggcccagagtgtctccatggcccccgatagtctctgacttcgccatttggttgaatcagttttcattaactcacggggaatatttgatctgctcatctcatagggatatagcaaaggcaatttgttgagtgttgggggaatggataaaggtgagtaacactaagttcctatttgataagtgtcattactgagaacttaaggccacctaacaccaaactgggaaaagcacaaaaaaatgcactaaaataaataataggcaagttgtgacatttgaatttcacgtatcttcattttcatttttatattttatttactattttgctccacaatttgagtcaaacatgtgatgagagttctaacttgatatgtttacttcagtcccaaacatagtcatctttggtcttttctcagatttggcctaaaactcgtagtttcattgatttttttttttaactaggcattcttctatgttctaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaatgcttttaacccaatactacgtattatgattgccagtacatcttcattgggacatagtattacagtagacataagacactcatcaaagtgtaaactcaaggtactttgtgaaagggaggtctaggggtcaaggaagatttgcaaaggaggtgatgattgagctgacacctaggcgataagaaggagctggcacagcaggacaaaggtgaagagggtcccaggcaggagggcgtgtgcttggggtggtgaaggaacagaagtaaggccagaaactttgtagaaaagtttagcaagccaagcaaacagcagccgggggttacgtaaataatgccgggccctggcacatttgggaagtctttgggtcttattttaagggcactaggaagggctttaaacagggaagttatatttcttcgagatcaggtgtacagctacaagtagccccaaccagtggtgatagggtcttggactcggtgaaggcagtgtggctggtggcaagtggcagaagtaaacgtgatctaacactgactgttcctggcaaaaccctggcaggtaagttagcagcaggtcaatatcccacagcaactgtatgtacccaccggagtttatataaccttttgctcccttctgtcactttgaaaacaagcaaactaagccttcaaacttcacacttcaaactcaacctacagtcattcccatgttccttctggttaacaatttacaaatgacatatttaaatgttagcattttgtagagagaatcaggagaatcagggttttttgtttttgtttttaaatctggtacaattaggtcatcctatttagtttaccgtttgcttgctacttgtaagaactaataactttaccagataaagtttagatttcatctgtactttaatctcaagaattcgagataaatagtggtaaggaagaaagtacaatgcgtacagctaatgaaacccaggaagatgagtcaatgcatagaaataattccaacccaaataaatactatttaaaatgctacttggagttttgccgtgatactagacacaatatggcaaatcatcctcaagaatacaagaactaaggtgtttccagtcctctttaacacctgtgatgcaggatatttggagagctaaattgttattattaacagtcttaatacctggccaccaacacagtagaggaaacagtttttaaagtgtcatacatctcttcaaatattcatacgcttaatgaaacattcgcacatctaaaaaggcatgcaatttctattgaaatcctgtgtgcctcttattctaagcagtgggactattgacccacattttaaaataaactatagaaaaggaactgtaacttttacacatttttaaaagacaacatatcagaaatctgagaaaaatatagaccatgtcccccaaaatgtgaaaaatttaagagtaaaaaataagatttgtgtcccaatctaaatgtttctgaggattaaaacacctcagtatttctgttttacaaggcttcgtccagatgttagggcccaaggaccatggtcaccctgcagaataagaagccaagaccaaaaggaatgcttagacttcccatctccttgttaaatataaaataatattttaaaaatcttattttcagggtcatagaggtagaagtgattttgtaaatctaatcctttcattttttgaacaaaaaaaaattaaatctaggaggtgaagtaatatactcaagctgacatggttagttagtaatcaaatcctgtcctaactcagaattcaattttacaacaccatagcaccttcctcctctggtctcataaattaaagatagaatagagaaagaggaagagtgggaggatggggaggacagtaggaggaggaggaagaaaatgtactcactttacttttcaaataaaactgcatctctcatcctaatgattatggaggacttcctgttttcagccattatcacacattgttgctctttactgtgatattggaatgccctgcagaacgaagcaggaaatccaataagtatttttctttatttaaagaaaacaaatgtttattaataaatgagaaatgctaaagatcattgactatcttgagggaccagagagctcagaattgctgcctctttcagttatttgggcatggcattgatgaagtactgaacaaaatacaccaacgtggcagtaaatcttatctgcccttaccttccctccctcataattttctctttctttctgtttcaactgttttacttcttcttcactcatcttcttaatttttgtttttgggtcagaaagaagcaactctggttgctttgaacccattccccaagatagtccatctccatgacctcccaactctgatcagttcccctgaacctctgtcccacattccaccccaccctggcccctgacccctcccatctccatcccgtggtcctgctatgggtgctcagtctggcatccatagctactttcccaggctcatcacctacacaaagtctctgctttagtcaacttgatctcttaatggtccccctcagaaagtgcagggccgcatcttcccctgccttcctggtgcttttcaagagctctctcaactccaaacccagctcggttcccacctcctccctgagccttctctagctgcctcaaccttaggcactgttctttcttctggatctgggtagaacatgcattgattatgcctgtagctcacttaggctgtcttttttttttttaacattatatccagtcaccttaaatactgaagggcaggcactggatcttgtagctataagtcattgctcagatctatctaggacactttcattcatatgatcctcaacaaacatttactgatgatgatgttaaaaactggagctcagaacaataactgctaatgtttatgtccggtgtaaaaacaaataacttccttttagggtatttttctaatgaagactccagtaaaccttaacaagaagctgttagtatggcttcacatgctatgagcaaatatagttccaaactctggctccataaatttctctttcctcttaaatcgttaataaatttgtgagtaaattacttgccatctgaattacagatttctgggtaggtgcaacgacgatgaaaatacctgcaggtgaattctttgtcctcttcacattttgctgcacattcttctctgcttcctgcccccagctgcttcttagtgacactgaacagtgaaggcccctgggtattcacatagtcatccaggggctctccttgacctagaggtgggagatccaagtggaataaatggtcagtaaatcaatgccaatgtctaattgtcatgacttccttttaatctatttggttagcattaaccaaataaaacttgctgtttactggaagtagaatgggtagctatgaatcaaaatgtttagttaagaacacacagttgggcatgtggacataaataaagatggcaactaaagacactggggactaccagagaagggagagagggagcgaggcaagggctgaaaaactacctatttagtaggtatttagctcactacctgggtgatgggaatcatttgtaccccaaagctcagtgtcacgcaatttagtgatgtaacaaacctgcacatgtacccctgactctaaaagttgaaattataaaacaaagaaaaacagtttcattaacagattgcaagatagtaaaagattaactggattgataaacaggttagaactatggaaccactactatgttaccatattagtggatataaatccttaaacaagaacaaattttatgtttgctatcaattgtgccatgtcatgagagaagagtaaggcaccatcagtggcagttgtgttaccaagattgatgttgatttgttcatccctgggtagaaatggaacttggaggccattgtttgatttcctacaatatgcgctttggttctgacactgtcacttgaactggtgggaagcatcctctgaatggtccctccttgaggcacataaattttggtgcatagatgatggtggaaataaacaagaactgaactaaattatgttgccaccttggacaaaaattgggcaaaacactggagggtaagaagctccccaacaaagaaggccatttttgtactgggctgatgacagtcacacaacactactaactggggagaaatcagtttttccaaggtgttgacaggtatctggatttcggaggaaattgtaaaaaagcagaacctgggacaaatactggtcttggtttttctttgagatcaaatctgagacaacgaatctgtccgaaagctgctttctgcctggtcgtggcagagggtggccaagggggcctcagctgtgctcccaccacaaggctacagggtgttcccttgtcctgaggctcttccggacatctggctgagctttggtaggtctattccaagcctggagatgccagctccatccttcgcacagaatgctagtgattttcacaggggtaagaggccaaaagaggctaataaaatgaagatagccaagctccatggaattagacaacaggacaaccttgaccactttgaggggcgtggtgggggctgcaggcagagggagtgggttatagagtgacgaggagagcagtggaggcggcagcgggagacaagcctggctctgaagacagcgagccctccagggaagatgcggtcaggggaggttctgaaagatgacacactgcagagcacactggtttgtatgctgatgacaaatatccagtaggaaggcaaatgaacagattctcattctcagaaaggcccgtcctgacctcctgagggtacacagagcacagggaggaggatgcacgctcatcaattcatgcaaagtcctcggccaaagtccccctgctccccacctctgggacttcgtccttcctcaatttaagacattccgggctggaaaaatggattattgagcaggagttggctgatgcattctaaacctaatccactaaaaagcacttgagagatgtatcaaaagatcacaaagaaatagatgctttaggcccatatccatgtctttaccccgcactttctgccaacttgaactctcatttccaagaagagttgtgttttggttaattctatagctcgcagtgtgacttcaaaacacacaataaatccacaaagtgtgtcctacggtgagttcagttaaactttctgaagagtttttttgaagtatagcagagcaggctacaattgatattcaaaaaaagaaaacttccatttatttcccccttcaattaagttctctgtgtcatgttattatacttcatagcacatcgctgctgagatcccctccccagctcctgtccctaggaaatatcccaaaacagaatcaaactgttttctttttaatttgaaataattttcccccattttttttttctcttattcacctctaggactcatatggcaataggatttgatagggcttatttgctggcaaggaaacatcaaatcttttagtggaaaaatacatttatattataggcaaaatgcagatgtatattgctactgatgcaaatgtattttattaatggtgtgagaatttcttcctcactgtggtgtgtgaatgtgtatgcatatttgcatgtgtaaaagacttaatttgtgaaatggaagatgtttctccacttcccactaagcatggctgtaaaagaaactttttcctctccccgggcattgcagcacactggaaagatgatacatccacagaaagcctggctttccaaaagagcttatgagagaatgttccccccaggttggttaaaacattggtaatcctgtggcggagaagtttgttctagcctttgggtgtagcccactgaataagttcacagtgatctatgtcatagtttccatgcattgaaatataatattcacacccccaacatacaccaatttcttacaaaaatttctttaattttctcctgctctgtattttgtttgatagctccttgaatggcttccactaaattcaaatgtatttgactctaaagtgcaacttgtaaaattttatctggtaatttatagattgaatttcaagtatacattatttacaggaagaactactagcaaatcgtatgattccgttcgtatgaaatgttcaaaatggcaaagatataaatacagaaagtagattagtggttgccagaagctgcagatcgggggtaacagctaaggagagtggagtgcgtttttgggggtatgaatagttttaaaatttattctgatggtggctgcacaactctcaatatattgaaatccattggattgtatgcctaaatgggtgaattctatacattaattatatctcaataaagcttttttttaaaaaaagaaaaagaaaaagaactactaggacatgtttagaatattatttcaaaggcttaaacaaagctgaaaagtgagaagagccctagattccttctgggaaacctggcttaaatccagttttctttatttcccagatttgagaatttggtcactgagcaaataacatgattttcctaagtctagatttctttgtttataaaatgagggtgaatatgctaccctacctataccgcgagctaaataagctagtatttgtaaaggacacacactcacactcacattcacacacaggtatgtatgtatgtgtaaaaatgtagcgacctaacccaagcactaagtgagtatttgttgaatcactgtctgcacacagcatctggcaaatggatgcgtgtgatttttccggggattagaggcaaacgtatactgatggaaagccttcctcaggccataacaaagggagaaatgctgaatccctgacgctgccaccaccatgaactggtgagagaacagaatatattcaaagagaaatttcattgttttaacttgcaagtgaggggagcatgacaccgtaagagagattatataaattagtcaaactgagaaccaggcgaagagcttagccgtcctttgcatagttagctacattggctctttttcaattagactggccattatgtgggtgcactcatttagatttgaaaaaccacccattattttctctgcgcattcattccagcacgctgacaatcttcacaggaaaactaaacttatttcttgaagaattcctcaatcttatacaagattttcaactgggagtttcatgaatcaaaaattaaatgaattgcacataaagccatggcatatgtatttgtactgcattgtgggagaaaaaataattattataatttaaaaaaactatgtcttacctgatttcagaaataaaagaagtagaagaaccacttccttatgttccattttgggactggccagcagtgcccagaaagtgtgtcccaatcccaggatgttgttgacttacatgagagtaaacgcatccacagaccagatagtcaaattaagttaatgattctctcagacacccacgccactggctcagcagggttcaaacacgaccttgaataaagggtccttacaaaatgattgagggtggaatctgcaatagatgctgggaagtggtgaaagcaatctcccccctcagctgctccatgctgccttcatgtctccttactccttccctcacctttgtactttatctctcacaattagtcttatttcctcccctcttcttttattccctttcttttggagaaaatgaaatcagaaaagtatctcacatttgctggaaccttccatgacgagaccctctgccaagcgctgcacgtccatagcctccctcaagcttcccaacaggcagtgctgttctcattcctgctgtacgagggatggggctgaggccttccccaaggttgtgtcgctacccaggggtgcagctgatagacaaaaccctttcaggtcctggatgacaaacttaagttaggtgtaaatgttaatatctccacatcctacaccaaatgacatagaaattacgacataagtgaaagtatcttattatcttcaaaatttctttattcccagtgaactcacatgttttctgtaattataaattataagacatcaatctttcccccaaatgaacgtatggcatattattatattctcattctcatgaaataaagcaagactggtagcactaagtggaaagcgtctatctcaattttaaatgttgaatctgtacttttccctggcttaagtctagagcaaccaggtagtatatatgttgtaaaacttctattttagtgttcaaagatatttagcaataaatcaattgacctctctattttagatgtgaaataaggaccagaaagcattgttcctctttccaggcagtgaaattcctgcctattcattaactggcaaaagagtagaggtgggagcccaatggtcttgggtggaacgtcctgtggaattccctgggattgaggaatcatgcagaaccctcaagaagaaaccacactgggcaacaagagggtggccccatgtgaggaacagggggaccgaatcgcatttcctgatttcctattctagcctcactctcttctctcctcaaattcttaccactccctttatcctctctgactcacctcgtggcccagttcattaaaggggacagaaggtggaggcaaattgagaaaccagcagtgggcagacgttttatttttaatgtgaaatgtctcttagggggcttatgttgatgtgcttgagaaagtactttgggggaaaaaaaaactaactctactaatatataatgcttccagcatgtatttatttccacttaaaatattattgtagcagttcctcttggataaggcatcttgggaatgatgttatcagaaattctacatccacataattttcttttcctgtttttttggttttgacttgggtagtgttggtatagcttttgcccacctttcccctggtaggtgttagatgcattaaattctacaaatgcgattttataaattagttgccctcctaatggcctcctggctgtacattcttccctaccttcataatccatcagcatcgtgaaagcacagagggacattgagcagagttctgtgctggcgccaccgcactctgtagcctgtaagagagcagcaaagaggaatgagttgctcaggtatagacaggggtggatgcatagagacttccactgtggcacggcccttcatgtccagggtaggcatgaagcaatggactattccagattgtgcataggaaaccacactgcactcttagacggatttttgctctaaagacaactaattcaaaataaggtgctttctacctgaaataatggcatgaactgagaaaagagatatagagagagatctctgtgtactacgatcaggttgcacatattctgagatttatgtattcttatttagttcaattccttatttactgaccacttactgtgtacaatattgtattagattcttttaggattacagttgacccttgaacaacttgggggcttggcacactgaccgtacacagtagaaaatccaggtataattctgattcccccaaacttaactactgatagcctgctgttgaccagcaacagttaataacatgtattttgtatgctatatgtattatatactgtattcttacaataaagtaagctagagaaaaggaaacgtttctaaggagaaaatacatctatggtactgttatgtatttatccatacagtaagtttacaccgcctgtttacaagatgaatcatctgtctgaaatggaagcaaccccagctacagacctcagtctctgttacatatcaagcaaatcaagtttttcttgtaatgtcaaatgtcatgacttttctctgcttcttgggagcacttccagcatcactagtgccacttcatgtggatcccatggtgttattcaaggtttacagtacagcacgaaacaggacgaaaaatacatgtgaacagggagagggcactttttactgggatgcgcaattcactggggatgacctgctcatgatggaatgttgagtatcacagaacgttttaagtggatacttgcaacacctgagctcattgcaacagcaacaggaggaggctatgaacttattaccgtactgtggtatgcactacggttaaatttatgcagttacaatttaatactgcatcttgatgtttgtatacacttctctcaactgagaatagcaccatatacgatctgtgagtgtgtacataagttttactaaattttaacttttgcaatagttttgttatattttatggtagtaaataataaaatagactaggtatctacatacattttatgcattcatgacatacttaactttttctatttttgttgatatttctagctgcatggtttgtctttgagttttttcaaattgttgcaaaactccaaaacattttctaacacatttattgaaaaaaatctgtgtgtaacagttcagacgtgtgttgttcaatgatcaactatatgtctaaagagtacaaatcagtctgtaaccttccccagcctctccatgctaaaggaactacaggaaactttcgcactcaagatgtgtggagattctgctgctgcacttgtagcaggcataagaacgttcaaataggccgggcgcggtggctaatgcccgtaatcccagcattttgggaggccaagacgggtggatcacgaggtcaggagttcgagaccagcctggccagcatggtgaaaccccatctctactaaaaatacaaaaaattagccgggcatggtggcatgctcctgtagtcccagatactggggaggctgaggcaggagaattgcttgaacccagcaggcagaggttgcagtgagccgagatcgtgccattgcactccagcctgggtgagagagcaagactctgtctcaaaaaaaaaaaaaaaaaaaaagaacattcaaataagattggagacaaattgaatttccttagctctgcccagcataaggcctgcaatcaagatccactcaggtcctcttatgaaggaatagacgtctcttccagcattaaaatggtaaattccttgcaagtatttacaaagaaagttataaacaccaggaaacatcaacctcaccaggaggtgaggtagagttcacccttccatctcacctgaagtggaaaatgcagccaagtcacaacttcctaggtgatgcacgtccatgcaagctggactgcattgctggcctgacatttgcacctggcagctcctcgccaccccctctttccaccttccttgagcccaggctctgctgcccgggaactgccattctaggacagctcatttcatcaagatgaacttctctgaatagccctaagaggacagtatcatttccaactggaaatagcaagaacttaattaatctactaaggattcatataaagcatccctctgtcgtggtaagggtcctcggcaagtttatctgtgccctcgatgccaatgtgcaggttgtttttactgctgttttagtgtattagagcatatcagcgaggagacttctactaattaacctggaggtggctcttctttctttagttgctcttttccacatgttagcctttgttcatcagtccccaggaccatgcaatgaggtgcttatcagccctcatgtcccgtaaagagatagcaggctatctctcaagttagcacagtggttaaaacgtaatccactagggggcattttcctttcctttctttctttctttctttttttttttttggaaacagaggctggctctgtcacccaggctggagtgcggtggtacaaacacagctcactgtagccttaacctcctggattcaagcgattctcccacctcagactccagagtagctgggaccacaggtgcacgccaccatgcacagctatttttttttttttttttgtattttctgtagggacagggttttgccatgttacccaggctggtcttgaactcctgggctcatgagatcctcctatctcagtctccagaagtgctgggattacaaatatgaggcactttgcctggcactaggagacactttctcagtgagacctaactcatttggggctcagtgaggtgatattttcttaattgagttgtgcttgaaaaaatctagatatctattcatctttgaaaaaattaattttcattggctgtctcctcatcattaataagcatggctgtgttacatgcttaagacaaatattagcagagaagaagaaagtcagacccggataacttagcagcctgcactgaggtggcaccaggactccccagaggagagacgagggtccttctgctctgaggtccagactcaccatggataaaacagagttgcaccaaatcatccttcccatctctcacattgattgttctctaagctcattcagagaaaaaaaaaatcttatctcacagtatgtcagggagataagtcatgtagaaaaaccttaaaatattttcaggaaagcaaatgagtgcacaaaaaacctggtgaaatctgagcaaggtctgcagactagtttctgatattgtgccaatggcaactttccagttgtaatcatgaactatagttatgtaagatactgcctgagggaggcggggccataggcacaaggatctctcagtactatatttgtaacttgttgtgtttatacttatttcaaaacaaaaattatatgtatatatttatatatgtatacatgttatgtttgcaacacatgtgcctatatttggatacatgtgtctattttaggaggacctaggatgatgtaactgctttcatactagttaagagaattcccaaatttcagggaaagtctaaagttatagagttcctaactcagggtgcagaactcggactttggctgattctcgtgagctcctgggatgagtgggtgggacagagaggcttctccaccaccacactccttccctggctggagaccagatggttaaggactgatgggtgccagagagcagcagccctccatgtgggtccagaacccagaggctggagtagttcatgcctgctcctgcctcccaggtattcaagggaaacccaccatctccacacaccagcaaaacaccagcaaaacagaggccccaagtaatgacttctcctttctcatcttatcttgccacctgaccagctcctgggctcctcaatccaaagttggggaagagagaagggaatgtcagtggaaaccacttttgctataaactctcatccttcagatgttctttcagtgggtacagtgtttagtgctgtgctaggtgctggggaatcaagagtaaataagaggccatctttgccctcagggagtttttggtctcatgggtttggggcaatgcaggtctgtaaactggaattgtaaaagtgaagtggcccaggtcccatttgttgtagtggtgcacagagagacagtcttgagaggtgaggagacatttcccagaggaagtaacatccaagttgagacttagaagacagctggaaggatgagaaaggagaataattctgtggagtcctaattaggcaaaaggaatcaggctggtgacactgaggaaaaaagaaagagaaagcagataagctgtaagtttgcctttcttcatggtccaggaccatagccctcctgcacaaatagctcacaatcttcctgtgcccagctaccatcaggccctcagctgatggaaaaatgcaggttatcccactgcaaccttggtgttatcagtactgcacaaagctctcttcagcacgcagcaaaagcaacatcctataaaacccccagcaagcctttgtctcttggcattcagttcctctcttgctggcctgcctgttgctgccttgcaacatattttcatactttcttcaataaatctgcctttatctacaactgtcttggtaaattcttcttactgcccatggtatactggcctcagatagttgcttcacctgctacacattctttaagcagaagaaatatatgtgcagggtcccagaggcaggaggagcagacagatgagaggaatttggctaacatggggaaatggtccaattgcgcaggcttctcactctgtttcaagaagtttagacttcagccaaagaaaggcagggactactgttactgaaggcttttaaaatccaagggtggcttgatccctctgattgcagcacagtgaggaggtcataggaggtgagagatgagagggggtgaaagaaggcagtggagaaagagaaaaaagaatggattagggggatgttgagaaagtagaattgacatgattttgtgactcattgaatgtggggaatgaaatcaagtatgctgcctgaatttctggcttggacatctggtggacagtggatcattcattaagaaggaatgcataggagggaataagatgaaattggctggggacaatgttatgtttaggaacttgagaaaacccaagtggaaatttccagaagggagttgaatattctggtttagaacaggagttggcaaactatagcccatgaagcaggcttatttttataaatcaagttttattggaacatggccacacccattcttttactattttctgtggctatatttgcaccaccttagcagagttgagcagatgtgacagagacagtacaatgaccagcaagccgataaaatatttgttatcatcgctttacagaaaaagtttgccaattcctggtgtagagcctaggaaagaggtctgagctggagatgtggaatcagcagttgtcagcagataggtgggactgaagcaatgggggtggacaagcttgctcagagagaaaaaaataagccctaggataaagccctcaacaacacaaggacccagaagaagagaattctgtagagatgactgagaacagttagccagaggggaaaattgacagtgtgagtccagagaagccagcaaaagtgaaaattgtaaaaaggtgggagtggtcatgggtaccaaagacttgtgagaaatcaagtgagatgtatcctgtgtatgccagaaggtaagagcaaatgaggccaacataaccttaataataccaatctcaatggcccagactccagcaaagtctactctagctaccgctaccactaaacatatgtaaaactcagtaaaatagcaattttaattaaacaaattcctgacctatctctgtaatactcctttcccaacatttttgcctgcatattctttgattgcctcttcaataatgttgtaatatcatagtctatgagagaagagaataataaactattttggctctagtattttattattgatagatttaaatttttcttctggcttcatagctcaggatcgataatggaagataagttttcaggattcttggcacacttaggaaaatctttatcaaactatttttatgtatgaactgtaagatttggaataattcccagatgggatgagctacactcttttctagctttgtacatttctatttttcttattcaacttttattttaagttcagggataaaagtgcagggttgttacataggtaaacatgtgtcatgggggtttgttgtgcagattatttcatcacccaggtattaagcctagtactcattagttatttttcctgatgctgtctctcttcccatcctccaaccctgatgggccccagtgtgtgttgttcccctcgatgtgtccatgtgttctcatcatttagctcccacttataagtgagaacatgcgatatttggttttctgttcttgtgttagtttgctgagaataatggcctccagctccatccatgttcctgcaaatgcacatgtcatgtgacacaatcgtgatgtaatctatggtcttgcatatttacattacaccaccaggtaaatcagcacgagggaggtgaagactattctgaatctgttttacacagggacagctagcaataaaatacacagaaatgactccataccacataaataaatcccatggaacccaaactcaatgactcaattcttcttttgctggatcctcaaaatgcccacatccactccaccaccacccaacatgagggcagaaagagatcagaattttagccaattacagctaaaatgtctgcttttgtcaaaagcaaatgaccaaatggatacattgccagggcccctccagagcctcagaaagggcctgctgaagttgccttttgctatgggatgaatcaaaccaaaacacagtggcttaaaataagatgaattattttatttctgaattctgaaggtctgctgggcttggccaggtgattctcattcttgtggtctcttatgaggtcagtggtggctagggctgaaaccatctcaaagccttcctcactcacatctcatgggtgatcccagctgttgctggaacctcatctgggactatcggccaaaacactcagaacttctccatgtgtctgggcttcctagaagacactgttcaagtagagggcaagacaatcaagaatctcaagctctatttcaaaacatttcttcccactccactactgctctatatatttttcacaatactttataccttctaacgtaatagttattatagaggtacacgtatgtcttactataacataaactccatgagggaagatatttttagttttgctcaatgaaatatccccagtgccaaggaagcactgccctacacattcatccaaatagtaaaataataaatatctatttttaaacactttgttaattctgcacacatttactttttctaaagggagaaatgtggaacactgaaaagctccttgaatcttagaatttgtttttaattaatagacttaatacatggcataacatgttgtactcaacttactcttcatgcaacgtgtaagcataaatgccaaagatcttactttcaagcatcagcattaatatagcaagttaggaaggtagacggtttggtaattacaaaagctcttgaagtaggcaaaaaccattgttttacatggtagccaagatcacactaatgataagtatttctggcttaaccagtcctcacagcaatatgctaaattaatgaaaacaaacatgggcattgtttgggtgttactgacatcaactacaaaacagaaatgaacagaaattgaaaactatattgtcaaatacaattaaaatagccaaatacatttctaggtaaaatctttataacttcaaatactgccagttttctttcaaaaacttacagtacttgaaagaacgaaaatcagcttaatccagcacaggggaaagaaacacatgagataactgaattttacaaccaaggtcagagaggatatcacactatcaccgtgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaatttttataaaattcctctgataagtatgcttaaaattaacatatttaccaatgtcaggatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccgtgctggaaaagacaataacagacgagtgaaaagaaattttatggaggaagatccataacacatacccataacaaatataaaaatgaactaacttcaaagcaggttatttcgggttttgttttttttatttccaacttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaacctgaactgtaaatatctgaatactttcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcaaagagggattaagcccaaggttatacagctattatagtaagttgcagggctatatataaaacacggccatctggttcaacaatccatgaagctgattaagcaatagacaataatgtagttaaatgacttgactcactagttaggaccagaattcaagttgcaattccctgtgtgattcctttcttttttttttgagacggagtctcgccttcttgcccaggctggagtgcagtggcacgatctcgactctctgcaagctccgcctcctgggttcacaccattctcctgcctcagcctcccgagtagctggaactacaagcgcccaccaccatgcctggctaattttttttgtatttttagtagagacggggtttcaccgtgttagacaggatggtctggatctcctgacctcgtgatccgcccatctcggcctcccaaagtgctgggattacaggcatgagccaccacacccagctgattattttccattataccaccagcctctttagctcacgtgccaatgtgaattcaaggccctaatagatggtcaaccacgaggtggattttcagaacacacatgagaaaaaattccttccactacaacttttttttttaagatggagtctcactcttgttgcccaggctggagtgcaatggtgtgatcttgattcatcacaacctctgcctcctgggttcaagcgattgtcctgcctcagcctcccgagtagctgggattacaggcatgcgccaccacacctggctaattctgtatttttagtagagatggggtttctccatgttggtcaggttggtctcgaacccctgatctcaggtgatccgatcaccttgccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcctgatcatatacattttcactattctctgttttcagtcatagtgggctgtcacttattcattctatgtcttgaacactttaaaaaaaaaactttattccctttagtttgttcatgaacactgtaagctggaggaaaagaaatcttaaagtctcactcttgaccacagtttctctcaatttgcaaatctggtaccttgaaaaatatccaaaaagacaagagagctgggcagaagattaagtcgtagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactttctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatgatgtccacaactgtaggtttacctaccaaaaaaaaagggcccaaaatagttctttttaaattgccaatttaagtctttataagcaatgatattcaaatactgtgaaactttgagtcttatcaaaaaaattaccaagtagtagaaaaaaattttaaaggaaaaaaggtaagagtattcaaaaaaaagttttattattttttttaaaacatctcggccaggtgtgctggctcatgcctgtaatcccagcactttgggaggctgaggcaggtggatcacttgaggtcaggagttggagaccagatggccaacatggtgaaaccctgtctctactaaaaatacaaaaattagccagggtggcaggtgcctgtaatcccagctactcgggaggctgaggcaggagaatcgcttgaacctgggaggcggaggttgcagtgagccaaaatcaggtcactgcactccagcctgggcgacagagtgagacaccatctcagcaacaacaacaacaaaatatcttacattttgttttcattactttcaaatccacacatcacatgtggtgaaacatgttcgaatgatgataatgaataaggaggtcacttacttacgttgttaagctgttaaatactatgtttagacatttatttcgagtgtatataataatgagccctactatggtagaatttctgtgtactgatcctagaagtctgactggatacaaaattcacacttttaaaagcaccctataactctaacactaccttgttgaaaacgacaaaatgtactatgtattaaaacccttccctctgaaaaaatgttcacattcctgaaattttatccctataggaaaaaaatgcaatttaaaaaaaaagaaaaaaggctgggcgtggtggcccttgcctgtaatcccagcactttgggaggccaaggcaggtggatcacttgaggtcaacgagttcgagaccagcctgtctgacatggagaaatcccatctctactaaaactacaaaaattagccaggcatgctgacagacacctgtaatcccagctacttggtaggctgaggcaggagaattgcttgaacctgggaggcagaggctgcagtgaaccgagatcgcgccactccgctccagcctgggtgacagagcgagactctgtctctaaataaataaataaataataaaaattaaagaaaaaatcacacacaaaggtaatcagtgtaatgtttatacataacaacaaaggattattagaaacaatctaaaaggttctaaaagttaaaaaaaggcattttacagaccatcaactcaatgaatattatacaaaatgtgttttaaaacccatttataacaatgatctataaaaacaatttttaggctgggcacggtggctcacgcctgcaatcccagcactttgggaggctgagacaggcggatcacaaggtcaggagatccagactatcctggctaacaccatgaaaccctgtctctactaaaaatacacaataattagccaggcgtagtggcgggcgcctgtagtcccagctactcggaaggctgaggcaggagaatggcgtgaacccgggaggcggagcttgcaatgagccaagattgcaccactatactccaggctgggcaacagagcaagactctctcaaaaaaaaaaaaaattttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaatgatactaaagaataatacatctttaacaatatattcacaaatccatatagaaaagatcttgaataggacatataagtatgtaactaaattgttgagcatattaataatgccaatagcatttccatttggcagaaaaagatgacaacacattaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactgctagacactgctggtaaagccggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcacaaaagctaccattgtctttccttaatttttataattttactatttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgcgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatccgcacaaaaacatgtatacaaatgttcatagcagtattattcgtaatagctaaaaagtacaaataacccaaatgttcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttgtatgactccgttcatatgaaaggtccagaaaaggcaaacccatagacacggaaagtagattagtggttggcaggaagtgaagtgaaggtgggggggtgaggtagaggaatggggagtcaccactagtgggtacaaggttcctttatggggtgaaaagatgttctaaaattaacagtggtgatggatgcacaactctgtgaatgtactaaaaaccactgtaccacacactttaaacagtgaattgtatggtatgtgaattttatatatttatataaataaagattccttaaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaaaaaaacgaagaacagtggtaccacctagggctggagaagtgaacaggatcacaccagctcctagaatgtatattaagagcaatggtcgatccccctttgccctctggtgttgggaattttggccttgttctaaaccagtttcccttcacagaagttcagccatcgtgtgggatcagaataaggtcctggggcaactaaaggtatctggccaagggtacatccgaaggaccctacaccggcccccagtccccaacagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggacccccccggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggtaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcaggcggctttacaggtcactgagacatttggagatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcgatcccagggagcttctcattctatgaccgactgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgaggggcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccaggacagactctttgcctccctctggtggagactgatattaatccaggtgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgtgacagtccttgtaatatcctaatattggaagtacagaaagaaacccaacagggaatggagactggtccaggatctccacctccttaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcccccacctgtttgggcaggcaatctcaaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctactttacatatacctgcccttccccagttggtcctctacactatcgtgcctatttctaaatggtgctttttcaagcatacccacagaccaatcagcatgcacttcccccatttcaagcccataaaaacctctagactcagcctcgtggctggcaacccaccttcgggtcccctctcgctgttgagagctttcttgtcactcattaaattctactctgccttactcagggaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaagtgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagggaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcatggataaaataattaacataaatattttaattactgcataaagttatccatttcactgcagctttaaaaataccatttttaaagagttctaagatgttatgtaaaataaattttaagtagatgcaaagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttagtatatgaaatctttcatataaacagttggaaagactactaaaatgaacatctatataccatgccttccatcaagaatcaataattgttaaaattttgccataggtgctttacctctgagacaatttaaatattaaaagccactctgctcactatgtccctcagtgagattagggctcagaataagcatggtatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactactacaacatacattatacatacattttgtataggtttcacaaaaccatatatactataatagagtttcagtgataatttcaactatgtaattgtcacctttagaacacattcaaatcagcattagggggacatgcactataaaattcattgtaatcaagattataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagtgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttgaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatgtgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaaccaagccgactctctctaggcattcaaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatacaccctccttaactggacacacataactgcttttctagctaactggaaagaaaaattttgctgtcttaaagattctctgggaacacaaccgcaacattaatttgggatcaggaaaattcaaagccaagagtctgttgcaacccatagaatttttttagaggaaatcttacacataattcacttcaactttgcacaagtaacaaaattataatgagaacaatattatatcccctgaatataagatgccactcataagatgtatcattatttcatgagaaactaagaaagaaaaagcactgccaattaaactatgacgcctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagaaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaaatactcatataagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaagtgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacattgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcatgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaaacccggtctctactaaaaatacaaaaattagctagccagacacagtggcgcacgcctgtagtcccagctactggggaggctgaggctggagaatcacttgaacgcgggaggcaaaggttgcagtgagccgagatcgtgccactgtactccagcctgggtgacagagtgagattctgtctcaaacaaacaaacaaacaaaacaaacaaacaaacaaaagtactacattgcctacttggaaatatttggaaatgacggggagagtttaaatttaggacaacagtcaaggggctggatacaaacagagaaatattctgaataaactataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcctatgcttccagggggaatgattcacaacctgggaaacctagactttacacactggcttttcttcttgttttaaggtagagagaaattcttaattgtaatgtggtcaagtgtgtcagccttttgtcgcttggtttgtgctttttgagtcttccccaagaagtccctccttctcaccatgaggtcataaaggtgttctctcgtgactggaaattttcacgtttccacttaggtccttgagccatctggaatttgtgtctgatttggtgcaatccagctctcctacagcctggctgggagacttggagcaagtcgggctccctgagtccccagctaacagatgagaagattaattaggccatctctgtggcatcttcatcacctacagttgcaaacattcagtcttccttgctgcagcctgtgaccagggtgatagtccagtcagcgtgataataaaataatcccgccgacttccatgctgcaaaaatgcagccacgctgacatagcattggctgtcctccccagctctcttccagaaacaaaacaaagcacctcaaagcaggtttcccaaggcccactcacggccagaactttgctttaaatcattccccttcgacagtttagttttaactatactgtatgtacccaagccaaggatgggaggagaagcctcagtaactagaattgttattaaaaccatatatccaactccactggcttttctggaaacctctacctaaaggacgtttaagtcgtctattaaaatatttcagacttgccctgaaggaggcaccaagaagtgccacaactttgcaggctagtgaccacacagatggaaatgtgtctctggaagcaagtggctggtgttagaaacacacacacacacacacacacatacacacacacactcccacaaataaaaatctagtcttccgtgttcactcgaattattgtaataatcactgaggatgtgagactctgtatttagtcagttctctaagtatgacccagcccagccgtaagaaaacatgggagggatgggtgaagaccccacagaggagggagagcctgactgaggggagccagccttcacaggggtcccggtggggatgcaggcaagaaactcagcccaagctcatctaaggtggaaggtatgcgtctgatcaagatacaggggcagggaggggtggtgtcctacaattctcaagggcctgagaaggaggccaggagcaaagttgtctgcccatcaggtccccaggtcctaccaaggcagagaccagctggtctctctgtcccagtagaaaattcctctggagagagaatctgattggcttgagatctgtgattaattttatgtgtcaacttaactgggccacaaagtccccagatatttggttaaacattattctaaataggaggctgggtacggtggctcacgcctgtcatcccaggactttgggaggccgagatgggcagaccacaaggtcaagagtttgagaccagcctggccaacatggtgaaaccctgtctctactaaaaatacaagaattagctgggtatggtggcgggtgcctgtaatcccagctactagggaggctgaggcaggagaattgcttgaactcgggaggcagagattgcagtgagccgagattgtgccactgcactccagcctgggtgacagagcaagactccatctcaataattaattaattaattaattaattaattaataggggttttctggatgagattaccatttagatcaatagactgggtcaagcagattgctactgtggtgggcctcatccgatcagtagagtcttgggtagaacaaaaaggctgaccttctgagggcaagagggaactccccctgcctgagtacctttgaacagggacactggttcttcctgggttgggagcctgctggccttggaacaggagctacaccattgggccttctgggctcaggcctttggactccaacaaaggcctgtgtgagaaatgatgtcgagaactggtcagttctcctgggtctccagctcgctggctgcaggtcttggaacttgtcagcctctgtaatcacatgagccaattaatgcacatcctactcttctctcggctctgtttctctgggggaccctgactaatccaaggtcccacagaacacaggtgactcctcgaggctcatctctgtggatgggagaggcagttcccagacaagggaacatcatgagtggggcagacacccacagaggcctacagtggccacttcactccaggagccgcacacctagctgcaggaacccgagccccagtgactagcgctcatgggaagggcctgcatcccagatatgtgatgacagcccatcccaaaggccagctcagaaaatgctaggatttgccttcacccccagtggggtcatgtgtatgaggggggcaagtgggaagggagactttggaccccaggccctgcccatcagccaccccatggctgaggggtcacccccataagctcttgaatgccagcacaaggcagtctggggaaacttggtgacgtggacagagcccctccttcagggaagtttctagactgggctgtgtgcttggagccactgtgctgggcacagcctcccccagttgaccatgggctctccaccatgtgctcctgccttagaatcagcctccttctctgtaagtggagatggccctggcggcccaggtatgagaggccccaatcaatggcacttctcccatccacctctgagctagcggggaaataagacacaagagtgaggcaggaaaagaccaaagcagcaacagccagggcctcttcccagtccccagggagcccctcggcccctacccactttcaaggccagcgatataataagtttgtttttgttttccaaataaaggtttatttctttctgcttaactctttttcaaaaaatttgattttattgtgctaagaacacttaccgtgcaatctcccctcttagctggtttctaggggcacaatacagtcttgttaactctaggcaggtgccatgcttcatggccggtccccagggcttattcatctcactgcactgaaacttgaggctctttgagcagcagctcttcagtcccctcccccagcccctggcaggaccatgctcctgtctgtttctgcgagtttcactattttatatacggcacgttagtggaatcaaacagtgttttgtgtctgccttcttcacttagcatcatgtcctccagattgatcaatgttgcagcatgtgtcagagtttccttccttttttttgaggctgaataatattccattattccattgcgtgaatacaacacattttctttatccattcatctgtcggtggacatttaggttgcttccacttcttggctattgtaaataggcttctaggagcataaggatgctgactgttttggataaatacccagaaatggggttgctggatcatatggtagtcctctttttaatttgtgatacgtttcatctctcactctggcgatgtctgagcttctcccttgatagaggtagaaagttccagagaggcacaggcaggcccgcagtgagaaggcctgagcctccttaccagggtatttctcccccacgggctgcctctcgctaactgcacagctcaatcacacgtcccttcccagggctgctgtgtgtcacacgctcacacccacactcgctccatctgtgctgggtcgaagagtgaccctgtatccacatccatccaggacctcagagtgtgaccctacttggaaatagggtctttgcgggtgtaactcattaagatgaggtcatactcttcatgttggatggtcatagtacatcaatgcctgttgttcttatgaaaggagaaaacagcagggccaggtagctcatacctgcaaccccagcaacttgggaggctgaggtgggaggcttgcttgaggtcaagaatgtgagaccagcctgggaaacatagcaagactccatctctaaaacaattttaaaaattaaaaaattagctggtggcacatgcgtataatcccagctactggggaggctgaggcaggaggattgctggagcccagctggagctgcagtgagtcgtgatcacactgctgccctctagcctgggccacagagcaagaccacgtctctacaaataaataaataaataaatgttttaaaaagagagccagggtctctctcttctctctctctctctctttctctctctctctctctctctctctctctctctctcacacacacacacacacacacacacacacacacacacacacacacacacacacgagggaatgtggtatggagacagaggcagagattggagtgactcagcccctccaaagagtgccaggaattgcaggcaaccaccagattcaggaggaggcaagtaaggacccgcccctgcaagtttcagtgggaccatgaccctgcccccacctcgatcttgcacttggagcctccatagctgagacagagtaaattgctgttgttgttagccactcagttggtgggcatttgttactgcagtcctgggaaacaaatgagccgtccactcactcatatacagcctacttctattttactggtgctttctgctaactcctctcctttccatctacatatttcctccttccagatctccctcacctccctcaagaggggctctgtggccaggaaacttttaatgagatctggaaaaagtgttacttgcacattaaatccattattttatgaatatcatggcttaagacaagctgaagtttaaaagtgagtgatttcaagttgatcagaagaaaaatatcaagtaaatggggtgcatggtgacacatgagttgctgaaatttggggagcactggaatgcaagaaacagcactgattcagggtctgtctgtaattctgggtccaaattctgctttccctactggcactgggacacacaggcattgttgaagtgctggaccccagatttctcttctgtaaaatggaatcacagggtctaaattggaggctttctctgaaggatgagaataaagttagaatgagaatgttcctagcatggtgcctggcatgagcagattctcagcagatgggccctcctgtaatccgctgagggctctcctgcagtgccagcagggatcctagtcattgtccccaccactcctgtctgtcttcacccagaaccttgtctggatcctgggaggaagcaaacatctcctggtgggaatgtgaggccctgccaggttgtaggagtaactggaaaagggcaggtggccctgcccactatgtgggcacctcatgataaatgatggctctcattagccctaactcctcaggcaccttcctacctggcaccattatgctgggactaccctctcactctgggagcttcacgataaacccatcttggcttaccctggacgcctgtcagctcctggcagggtgcaggccagagggataccttttgcatcatgagattgtgcaacttgggaggctgaggcgggaggcttggttgaggccaggagtgttctggcaagttcacggaaagttctggcaagtaggcaggccagcctcttgcttagacagtgctaaaaggattctttttcactatctgccagtaaggaaagtggccatcttgttcagaggacggagtgcagcatccacatacctaccagcatgaacttggtgagcagaggccacctgcatcccagagccacagggtccctggagctattggcttcttgcctggatacttccaggattcccagtttctggaagctctggttgcagtgtgccctggttctgtggcacccagcaggtctgcaagggcagccagtgggtgtgagtctggagagtgaacatccctatgagaactgactcgtgaccctgagtttatcaccaaggggcctctgcagagacaggtcctcaaattaagagccaggcaaacctgtagagagagaggctctgggggtagactgggaggagtggaggatggtcaactgtccccacgcacttcacgaggattctccacctcccatgtcccctggcatggggagtgcaagataacaaaaaaaaaaaaaaagagaaggcagtgagcaggacccactcttcctgcagcttcttcacactcttcctacagccccagctgggccacctgcaccagtctgtctgcatctggggttggggtaggtgggttctggctggtttatggagagcctgctcctccatgaggtccatatctgttatttttccgcggcatcagcataagaggtttctggttttatgtatgtattttctggctctggctcctggtctgcatttgtatgcacaagaaggcataagagagatagagcactggatttccagagacatgtgtctggcagcattcgggaaaataacattatagcctaggaatcccatcacacatatgtgcacacatgcccacatgcaggatcatggtatgttggtggtggtgcagtttgtgcccatgaaggaaattgaaaacacttgttggagagaaaacccagtcgctggcatactattcccatcacagaagaggcagagcctatgattggtgcctcactgaatcacaggaagtgttttattttatccccacatcatgatggagggccacagctgccagctatgtctatttcttatgcacaatatagaccacaagagagaataaaacaacctcaaaactacagtgtggaaaaaaacctgtcagctagaaagggggagaaggtatctccaggagccaagaaaatctcttcaaggaaaaataaaaaaagtaacccactttactttttccccaaactgacaaatttgacttgtcagatgtaagtttaacttgtggacaatccactcaagactgataatcgccatagtaactgctgtgtcacatgatcacacagaagcctagagacggggaaagtggctttccaggccacttttcttctggtaaattctgtgatgtcagcctaattagcaggagtggaatcaggaccttggttgaagtaattggcagcccttctttaaaaagaacaaaggtattttagcaccttctcttcctgtttatgggggcctgtgccaggaccaacagggctctggtgcggagtcttcctcacccttcttcctaactggccaagctccaagcagtgcctctaaatgtgattctttgtagagccatgtctggagaaaaactcgaatttatctcctgaagttttcaaaatatcagaaactggtgagagagggggccgggaatacatttcagggctatcccgtttctttttaattagtattgtacatttcaacttctttcatttccaactgcttctccctgcaaaataaaggtatcatgtctttaaagctctccgtccatgacaacattttgttcttatactagaaaatgccattcccttcccaaggcacatctcttttagttgggtttaatttgagatgcctcttgcctgctaaaaacattggtgacttgccccagcaaggaggtgacagggccacttgtccatgttggccccctccagtgggactgagtggccaccacccccagtggctgcctttcacaggaagagaactgccttcttcaccgccgggcatcggcctgtggaaatctgtgcccagacagctcaggtggcagcttatccaagtccccagcactctgctttgtctgccccaggacaattgccccattgtcttcaggctaatgaagtttctggtcaaaacacaatgatttcaaacatctcttgagcctctctgccctccatctggaacagatgagtacatcaatcccttcaaacctgcctcctccaagtgcattctgcagagttagtgtgtgggggtgcattttaatcaaccacgttggccaatgctgcctacctggagtgaccccaacccccaactaaactgtgagctgtggaaatgaacagaagccagccaaatgaggagcaaaggctatttattcagagcttgtgctagcgagggagtcagccaccatcccttgtgttttggcagaaactcagaggcaggtaggggagtgggaaagcctcaaagaagaaagaaaggaagccttcgggttgccctgagtggagggtgttggcctggggaaaatgaaggtggctataagaaatgagactcccatgtgattggttagggagcatgtttggctttctttcattggtcctaagttggaagtggggacaaaaacctagggaatcaggctgggcatggtggctcatgcctgtaatcccagcactttgggaggctgaagtgggcagatcacttgaggtcaggagtttgagaccagcctggccaacatgttgaaaccccgtctctactaaatatacaaaaagttagctgggcatggtggtgtgcacctgtaatcccagctactcaggatactgaggtggcagaatcgctcgaacccgggaggcggaggttgcagtgagctgagatcatgctgctgcactccagcctgggggacagagcaagactccatctcaaaacaaaaacaaaacaaaacaaaaaaacctaaggaatcggtcagttattaatcgagtcctagaattttggggctgattgctataggagctgttgtttggcttctgggatgattgctacagattgtgggtcagagtcctgtctttctatatggtcttgacattgtctgtatattgactctctcagtgtgtacaggctgtcttctcccagcctgcttaaaattaatgagagtttgaacagacgagtgtgtggagggcacatcatcattagtacaaatagccacagatggaaattctgcatgcctttgacagaactgagtttgagaggctctacctcaacagcttcctcagcccagctgaagtctctctccctgaaggcccatgcacctttctcagccattgctgggaattcaggattgtgtgttggaggccaacattgggtaccatgagtggaaaccatgaactggggcaagtcctcctggtacacacacccagctactttttccttcctcttctgccccatcccagggaaccctctttgtaccatcccacccactggccaaacttcagggtcttgtcttcatacttactgcttttttctaagggaaaagttattgagaaggcagtcaaggttcatttatttttaaccaggagacagtgcccccaaacaagaactgagtccctagttatggaatgtcagacacctcgcagcaggtggtggttctgaaacacccggatccagatggcagccaactccacccacatgtcaggcgggcgacagcatttccggacatattccttgtttagatgaggagattctgcccccagtaacattccttcaagcagcaaaatgatgctagatctttccagaggtcacagactgaaggcttgggggctacagtctggaatgtgttttgcttggcacacatgcattttaagttgtttaatgacctatcaagatttaaagatcaggagctgacctttcatgttaaaaagaaaatctatattttccaacttgtcttggaaaatgggatgctctggcaacacttggccatcttcccaccttcagatgctcagcagaatggcagctgccctgtggagaggaagcacctgttcccttccttgccactctccctggctggcctgcagttttctcctgtgtgtcacagttatggactgactgcttgtgtcctgccaaattcatatgttgaaatcctaacccccaaggtgatcatattaggagatgaggcctttgggaagtgatgaggtcacgagggtggagccctcatgaatgggattagcgcccttatgaaagagaccccagagagctctctcactgtctttccaccatgcatgaaaatgagatgttaaagtcttcaacctggaagagggtccctgccagaatccggccatgctgggacctgatcttggacttttgagaactgtgagaagtaattttcagttgtttacaagtcatcccatcaatggtattccactatggcagtccaaactgactaggtgactcaccttcttggcccagtgggcatttgatccagaataactcattactgtctgaggaaattcccactgtctcttttcccagaagtttttgtttctggtggcttcttgggggattccaggcacagtagggccaagcaatgggtatagagtgaccctacacctttgacttggcctcctgtggacttagatggatgggtgtgtttcctaggagccctctttcctgtcctcaacccttttcccatgagaaatgcctcttcttgcctcagaaacaaacgaaggggtcagtgtctgccaatgtctgctcagcccagagtgaatgtctgagagattcagtgtgaatgtgctggttgcctgctacagatcaggcttggcaggtggtggtaggtggttaaggttccagtttcagcatcaagtatgagttgttactgctcagagtctcagttttctcatctgtaaaatgggaagattcctagctctcaaatttataaggctccactggccgtgtgtaaaatgtggcaattagggaatactgttggctgttaactatatccaccaggacaggctggttatgctctggtaaaaaataaacccaaactcaatgtctgcgcccagcacacatttatctcttgtgcatgctatatggccatcttgactcagcagggttctattctctgtcacctttacttaggagtgttggttggaagaatcccccaaagtagtgccatcagtctctatggcaggggaaaggggacatggtgtatcaagccttgggcttgaaggtctattcccagaagagacatcattaccgcaactcacgtttcattggccaaagtgagtcacaagccaagtttaacttcaaggagcatgcccccaagcctctgattctaagtgctaccgccttaacacatttgagctcctgtaacaaaatgccataagctgggtgacttataaacaagagaaattatttctcccagttctggaggctggaaagtccaagaccaaggcactggcagatttggtgtctaatgagaacctatttcctggttaatagatggtgccttcttgctgtatcattacacggtggaaggggcaaacaaactctctggggcctcttttataagggcactgatcccattaacgacagctctgcctttatgacctaatcaccttccagagcccccacctcctaatgccctcactgggggctaggtttctccatatgaattctggggggacacaaacattcagaccatggcagcgctctcttccctcaccgcgtggctggctctccaactacaacaccatgccccatggctcacttccaaggagactttctggagaggtttgtcctaagagacagaagaatgcatcctgcctcaagttttagttgcataggttcaccctacagtgaggtaatagttacacattcttaatgaaaagatccaaaagcccaatacatcctgttctgcagcatataaagcatcttcttcagacctggtccaagactactctgggatttttgagtcagaagagagccagagcctattcagtatgctgtttgactctgatcccagcagccaccaccatgttaacaggatgagcagggctttcttcaactcagggttcctgtgaaattaaaaagaattctcatcttgactcaggattgttgaacactattgatacttcttccaaggtctcacaagagtttgcctcctctcattgccatgtgaagacctctgtgggggaacaatgcatgggttcttggggtattataggggactacagagaagtgtcacctccacccaacagcctgattcagtctactcctcaggaggaacacaaagtggtctctctagtgccatgaaaccccaaaaagtgtcaaccagtattaaaggcctgcctgatatacaaccctcgaatgcaacacagtgtccttctgaggccactctaaaggccaggaaaggtttgctaagaagtctgtgctgttaaaaacagaagaaaaagacccttatcccattgctctgtgtctggtggctatagggacagtatttcataaaaaaagaaaggcaaaaataattttcaaaaatgattcaagaaatgctgtcaaagatagcaaagaacagagtcctcagagaacagtgcccaggacaggataagcactcaataacatataacactgtgtagtgctgttgagtgctggctgttgttgagtgctagctattgttgagtgcttgttgttgagtgctagctgctgagtgctagctgttgttgagtgcttgttgttgagtgctagctgttgttgggtgcttgttgttgagtgctagctgttgttgagtgcttgttgttgagtgctagctgttgttgagtgattgttgttgagtgctagctgttgttgagtgctagctgttgttgaatgctagctgttgctgagtgcttgttgttgagtgctagctgttgttgagtgcttgtcctgcctgggccctgtttttagcctttgatgtacatttctccatttaacttccacaatagccctattaggcagctagtattattatttctgttttacagataaagattggttttagctcagagtagttctgaatcttataaaaagaaaaaaatatccccaggaactgaatcggctccaaaatagccccatcttgggctaaatatgggatgtgacaaagccaccatgaagctaggcccccctgtcctgacagctttccaccccttccctgcccctctcaccctgctttccaggggcaatgcacctccccacttctcctgggaggggtgggcatcctctcagtcccataatctgtgccaggcccacatatgaggacttgacaggattcagcagagatgcaggcctctgctctgctctgctcatctctttgcatatagtaatttaatgaggacaaaaactgcatagagctagtaatggcacgaccaagcagcagcttaagctttgagccgctaaactatgctgcctcctattgtaatacgattatattataacacaagttcaagagaccacccactgctttctttattggatcttccaataaagtggccatgctagtagcacaattccccacggaaatagataatgactattctaaaataaatccgaggacacacccagccacaaagtgggaggtgtattatacaaatgcaaccagggcctctggatctggcatttagacccacagcaacagcttgtgtttgctcagggctaagaatgcaggactcagacaccgagagcctctgagctgctgcaaactcatcaacccctccctattaaaggccattctgactaccctcagttttcctcaaagagcagttgagagctaaggtagggtagggagccaagaggaggcagggagagccagagatggcagccggcaacaggacacagaaagaaaagggacttcaaaggcagatctaataactcacagggctttttggtgcagagtctggagataatgcacagaaatgacaccttgaaaggggaaggaaaagaaggaagaacacatcatcagccccggacttcaggtggctgaaggagagaatgtatttggcatctaccatatctttgcatccttcaatgacacatttgtccatgtcactgatctttctggcaaaaaaaaaaaaaaaaaatgtgctgtgtgactggtgggatgaaggtaaagggtggccagatgaatcctctccacatgctgccacgctggccacccaggatgtggcctagaggtgcaaggaaccagacaccactggcctacatcaaactccaggccacagatggaaataggactgagatccctggacctggggcccgctcaggtatgaagatcaggtggattgaggatgtcactgccatcccctccaaaagcacctgcaggaagggggttgccatggtcaccatctgtgaacaggactcctcaaaatgttttctgttaataaattgccttcaagtaaactgaaaaaaaaaaaaaaagagggagagaattcacacaaaatgatgcccagtcttggtctgcatggtgaagggcccaggactgatgggcgggggctcatttgcataccacaacaccagggagagtcctgtcacctgccctcctgagtcctgaagaaaacccttcactccaattccctgtacactgcttctaaaggcaggaaatgtgtacagttctagaattacagtcacataaaatgctagaagaataacgtgatttatttaagtgcttagaggtacccccttgaagtttgtgttacctggaagttggcctcagggaaacacctcattgaccttctctcaaggataaatgagatgcagggacagggaagggagaaaggttattttaacatttcattcacagtccctgggattctttggagagcaccttaggaatgttcttaacctgagtcctcttactaagtattatcacatagtctgccaggctggcattattaaccctactttgcagctgaggcaactacaagagatgaccctatcgggctagtgaagtggaattcgccatgtactgcatgcagtcatgtactgcagtgaccaatccgggtctaatttctttgatgatatcattgacggggtagcaggggagaggcaagtgcaagagaagaaatggggtgaaacccactgcagggaagcttgggctggggcaggatcggggagccagggtatggggcatggttgggactgaaacccttgttaacactggctttagcaaaagaaatgggcaccacaatcccagaggacttccagaagcttcctccctcccccgcacctgggcacagagccttacctcccctgcaccctggccctgtctctctatttggcaagactcccatgtcatctgctcctctttacttcgggtccctcttggcactggaaatactaagtgaacccagcagttgcacaggattctaggaatttctcctttccaacttcctgaactggttttctaattcacctcagaggtaccttaacaaatcatgttccaaggccaggcacagtggctcacgcctgtaatcccagcactttgggaggtcgaggcaggaggacctcctgagcccaggagttcaagaccagcctgggcaacatagtgagaccgtgtctctacaaaaaataaaagaattatcctggtgtggtggtgtgtgccactacactccagcctggatgaaagtgagagatctctttcgaaaaactcacgctccacacaatcaggaggtctgccatccacagactccagacagatagttccatcagccagcaggagcggcatgggcaacgtcagtagcatgcacatcaggttagcttctctgaggtcacaaagttgcctggaagtggggaatccatgagggccaggccctccacaggaggaggacttccctctccagtcaccggcctccctgatgtggttccctcctctcagcccacatgctcctgccgaggtaacatgtccccccactctatgttagaaaaccataaagcccccaagagacgtttctaccaatcatctaaatattgagtttcaccttataaaatttataaaacgtaaagaacacttggaacagcccagttttaatgcctccagcttttgttttccaaagaacaattggtagacttggccccgaggggagcagagcccggctctcagacaacgagcctcaccagcaattctgtatcttcgaggcggcagaggtttttgtgatcttgtgtcatttctaaacacgacggtgtagatgggatcctcttcattttgcaaatgagaaaatggaaaaacccgagggacaaagggcctctctcaaggtgccatggtgagaaggaggcagaaggaagaggacctcgcccctgccttgattccactgactgctgtttatcacaccatgagtgtcttcagggagcagtcgttctcccgctggaatgtttacatgaggagcaaatgtgatgccatcacataattccagtgagggctggtcatcccctgcaaggctgaaatgaccctgtctgttttaatgctaaggaagcagcagcttttctcccactcccacacaggatgtgtgcagcatcttcaagtctctgcctcgcgtttctagatctgtagtgagctctccatggtcagggagtggatctttcagttgggtatttttctgaagcaactgtcattctttgctttttgtaacaagacatgtttttaaaatcctctgagagagaaagagtgttgccagaaaaggaatgaagagtgggagaaaggtgcattgtggagctgtctgagcgttggagtatgtcccaataacgaagagactgcggagaagcatcccctgtccccctccgtgttctaaatgtatgaaacctaacaaggtaattgcatgggaataacacactgtgaatgttatgtgggatttgaaattgtcatcccaagagtgaccaggtggagagaggaagggtgaactctttcagtctaaaagctatgttttaaaaggcagggttagactatgtttgtttctgcagtgtattttctctgcataaagggatttttttcctactttttctgctggtggacgtttcccttgggggagcctggccaatgaaaggtcacacagagaccagtcactctcaggaacaccagcagagccgggcagacacatgtcctaattttcccaggagcagactgattgaaccataggagggtctgtctgatgtttatcttggcagaattctcagatgagttagcaaatagtggctggagataaactgaaactttgagcaacctctggactgactctgattaccctccacaccctacctgcacagggaggagagaccacaaagccagcagcaaacagtaaacttttccaagaatcagagaggaaggagttcctgacaccctgcagcaaaaacaacctcaaaattcccctgaagacagacccatgggagctggggtcaaggtggccttgcgcttcaccgaggaggtgtcattaccaaacgtgctggacattggctacctacggaagaaagattaaggactgaaagaaaatagtggagaacatgcttttgacatgggggtaggacagggaaggccttgagcaagacacaaatcacaaaagcaaatagagaaagagtgatgtctaccttcaatgaaatgtgaaacttctgattcaaaatcggaaacctctataagctgagataaaagacaagcaacagagttggagaagatatttctaacatttgtatgtgtgcaaatgtatgtgtgtaatgtgcttatacatatacatatagataaatgcgtgcgtatacacatgaattctggattgttatctaggctctatgaagaattcctatctgttaataagaaaaaagaccaagatcaacaacctcatagacaagtggataaagaagatgaccagttagtccacagaaaagaaaatgcaaatggaagtgggagggcccagaggaactcttgctttatctaaattgtgttgattacgggagcatatgcttatattaattttataggtaaaaaaacagaaaaagtacctgaagattaaacctaagcaatgcgatgtgtcagttttgacaacacacaggaaggggctctcagcctgtaaaataggagcccttttgtgtgaagctgaccagatgcggagaagtttcaacagtcctagagaagaggaccgcaggggacagagagccagggaacagggcagggaggatctaagagggcacccggccaagcggttcactgcagctggtgcagggctcagctataccctggggctgggcgcttagcacagtgtggtcagatgaaggcaagcaagcagtggcagggactctccatttgagtcaaagtgacaagcagtgcccccagtccctgggaaggatgaaatccaaatttaattcccttctgaacaacattctacaatctatgcttcatttaggtatctgtaagcctaaaagagctgaaaaatcattttatttccccttccaatgtacaatttctaagacatttgaattatcgatgttgaagtttcattgagaatgagctgagtgtcctgctttcggcctgaaaacaaagcctcagccacagtcttcgtctcaccctctttctctctgtttattttcttttaaaaagtttctcccatttctttgttctttaacaaagagttgtgtgcatcttctaagctccaagtgctgcactggcttccagcagacaatggcaaccgtggccctgacctcatggcgtgactgaacggagggtctcggccaggaacgtgagggacgccagaaagaggacattggtgggcaatgaggggtcttccttgcgggggggtgttggggggtgtgctgtgcttccctagcagtccacgaccactggcaggggacaccccgggcagaccagtggtccaaatttataccagcgaaaagcaaatgctgatgccttcccaatcacggttccttcaaaggcttcagggttccttgggaagggaaaagaacattagttcagctcctgcgatgtgctgggactgtgctaggaagtttcacagatgctagttcatttagattggatatgcctcctggaccagtgtgctgtccattatggaaaatcaaaacagccattgcatttccatagtgttcacaaggagcctcatttctgggctcaggcaggctgaggcgttccagggttgagaatcagacttggtgactgagcaggaactgttgtcctttttctcttttgagatatgaaatttgcttcacatctcagaagagtgtgtgcctccatcccacacttgggacaagcgccgttattccttttttaaaacatctgtagaacatattaaatgctctgctttcttcacgggttaaatcatgctggggcgggaggcttgtggtgtaagagcggtgcactgtgcatccactagggctctcccgtcattccagttggtctccttgccacgccccagctcgctgcccccaggctgtcttggacagacacatttgtgttttgtaatagagcacatcatgcactattatatggggatattttataaaggagcccacgtgacacaaggaaactaggagaaaacaatcctagaaatccccaaagcttggaagcagggacatgcaagcgaggtacagcatatgctatcaagtggcaatgtccttccagtaggaaagccgctgttgtcatcagtttaggcaggtgctgggattaagcacatctaccactcagaaaataataccaataagaaccacggtccacatccaacatgggtctcccaaattctctaaaatgtggaagtgtgcagatcttagcatctctgtcctttctctcgcttcgaggaagttgggctcctgggcactgcctcatcagtcatgcccagtacctgtgtacaggtgcctcccctgctctctggagcatcgggactggaaggattgggaacagaacggagctttgattgatcctcttgtccgcacttgtgcctttcaactccctgtggtggagggtgacagtttagtctccctgtcttctcctggggtcccaccggctcctgaatcaaatcctgctcttcccctgcatgttctgagtggcctgtacactctgggctctctctctccttgacccctggaacaccacctctttggttcttagtaaaccggagccttcctacctggtagtagcactgacatcctcttcatccactggaagcttccagatcctggcccccacaacccattctctccccatagggcttccacagaaacacaacgtgtactgtgtgccaaatgactggcccagaggatgagtgagtgggggaccaatgtaggctaggggaggggtcagaagagaaaagttccaagagagtgggaacccaaggaaggcttcttagaggagctgggacacattggggcctgaaggaagtggacatttagacgatcataaagactgcagggatgtccaaccttttggtttcactgggccacattggaagaagaagtgtcttgagccacacgtaaaatacactaacactaatgttagctgatgaagaacaacaaaaataatagcaaaaagtctcataatgctttaagaaaatttatgaatttacgttggcccacattcaaagctgtcctgggccacatgcatcctgcgggcttgggttggacaggcttgagctaaagcaagtgtgttctgagctggagagaaggccagccccatggttcatcgttcgtggtatcaccaaccaatgatactaggaacagttggtgggtgcaggccctgggcagggcaataataagaaaaagcttagaaaagaaaaggaggaggaggaggggagttgcgggtcatggagggccttgaaagcgagactgagggtttggaccttaccttttcggcatactaccgagcaggaacccctgtcactgtaatttctgatgattctgccttccatctttgggaataacaatgacatagtcgactactcctctacaaaaagagtcgtcagattctttaaccatgtggggcatcttgttttggcatccacactagttctgttacagccaaagctgggggtgttggggaatgtcgcatgcttcaggggtatctgtgtagtgtgcattttacccagctgagctcacaactttaatgtgtgaaggtgatcctccagttcaggaggacagagttggtgcccctgcctgtaccatcctaagagaggtttctgcttcctgtgtcctgctctgtgggctccccaggtacccctgtagtttttgcctaatactttggaaccaacaataataacttatgaaatctttatttcaaacacagcttgaatttcatccattttcatcttacccaaagagatagattctctagtccgcaatctggatggtcagaatggagaaatccccttacctgcaaacacaggtcttttattttgtaaccactgtctgtctggttttctgttttggagtctcccagggtgatggtgccgccagataaaagttctaatgagagagggagggtgggagggaggttccggtggcaaggcagggcggaaggtaagcggagaccttctccaatcagaagtctagaaggcagggcacgcagtaggtctgcagaatgactcagaacccgcgtatgaatgctgtctattcatgggtccaggcttttgttaaagcctgggcctgcattttaaagagggagtcagggaactggctggactggtctgacaactaaggagtggtgaacacttcccccaggctagtactcaggtggatgaagtcatcaatattttctgggcagtcctaatctgtgattaacttttatctctgctgtgaaataacagcctccttttcagcctgctaacaataagttaacctggctgcccggctgggggatattttatgctgggctccagcagaggcacacttgagaagccatgtgggactcctgccctggagagagcccagagtagagggaggggtctgtatggtggtgggagtcctctcagcaatggtccttgtgattccggtatactctgatgtcctgacttcaaactcagcttacccaaagcaaatgtccactttcttccgtactcctttcttgtttaaagcctcaccactgaccaggaagtcttgatagagccatctagtaattcttaagtcctacctcatccaaccttgttttgactcctgcagtgagcacagctgccctcaccctcccctctctatgccctcacctttgcaggagactctcaatttctcagtccacatcagctctcagaccaccaaagcaagggttatttttctaaaagacatttgttcccattgctcctctgactaaagttcctactatgggacatttgcccttggcactcaaggaccttgcaatcaggctgagaacctcaggttctcaaactcaagaccatggggaatgtaataggtgaatcaggcaggtgaagtccaggactctttttggtttatattttgtttactcagttttgatggagacaagcataccagaaaattcacattcctcttaactctagcagtagacaaacaacagagcaagcaggatgtgaccatttatacatggcctcactgttggggaggcagtagggagtgttggagaccagggtcaggactagggctagggcaaggctaggaaggtgcccaggatgcatgttttaaggaagcactcactcttggggctttgcaagtacaaggctagcactgggagatgagtgcctccttaaagttggcttcttgggccttgtttgcctgacctagtctggccttggtgaggacagtggagaaatggagcatggacctacccaaagggatggctgctgatcagcttcacctagctgttgccaaaggcaacactgtggccccacttttgccaaatcttttcaaacattctgtgggtgcttccatcatagctattatcacctggcaagggagttgtccccacaggtaaccttctcactaagtgggggtgtctgaggccagggagagctctactcattcccctgtgtgatcccagcagtgagcatagagcaggtgccctgcaatgttaagcaaaaaaaaaaaaaaaaaaaaaaaaagactttggaaatagagttatggagccaggatgggtcttgagttagcctcactctttatttctttattcaaggaatggttgttcagggccagcggctcagccctgggagcactgactgcttcaagacacagactcctctgggatgccaggcagagtctgctcctgaaggcagactccactcttcatggggctccctccattactcattaggtcacagaataatagaaaaaggcaggaaagatgaaaaaagagaatttaagaacaaaacacgtccaggtgtggtggctcacacccgtaatcccagcactttgggaggctgaggcaggcagttcatctgaggtcaggagttcgagaccagtctggccaacatgaagaaaccctatctctactaaaaatacaaaaattagctgggcgtggtggtgggcacttgtaatcccagctactagggaggctgagcccagacaatcacttaaacccgggaggtggaggttgcagtgagctgagattgcaccactgcattccagcctgggtgacagagcaagactctgtctcaaaaaaacccaaaccccacccccccaaaacccaaaacacatggtagcaaaataataacaaattgaagtatgtctgtaatgacagcaaatgggaacttacctactccaagacagaaaatgattagattagatttctaaaaagtccaggtaggtcttgcttccaagataccatctaagatgaaatcacacaggctgaaaataaaggaatggaaaaatatacactatttaaatgctagcaatagcagacagattataataggagagagactatataataatcaaggcaccaaccgactcagaagctgtcacaggcccaaatgtatatgtatgtgtctaacatacacgcacctcaaaatatagtaagcaaattgacagaactacaagtctaagattacaacccatttaacttgatcaaaagttgataaatcaagcaatttaaaaagtactaggttataaaagatttgaaaaacaaaagtaacaagcattatctaatgggtgtgtgtgtgtaaaactttgcggccaaacataaatggtcatcatagatcatttaaaaacagttggtgatatacagattatttaaaaatttgaccacatactaggtcacaaagaactcaacaaatatctagaatcatcaaataacacagatcatattctctaaacacaacccaattaaattagaagtcaatactaaaatacagtctcaaactcatatatgtgggaactaaaaaattcactccctagtaactaataggctgaagaagaaattacaacagaaatttgaggagtttgagaccagcctgggcaacaatgcaaaaccctgtttctacaaaaaattagccaggtgtggtggtgggtgcctgtggtcccagctacttgggagactgagttgggaggactgcttgatcccaggaggtggaggttgcagtgagccattatcatgccattacactccagcctgggccacagagtgagaccttgttgaaaaaagaaagaatatctagaggtaaatttatagtctgacatgaatttatttcaaaatcatgagaggtttaagcgagctgagtgctcaaaatagcaattgtaaggaacttccttaatgtgataaaggttatctatcaaaagtgtatagtaaacattataattaatggtgaaactttggaagcatgcccatcaatatcagtaacaagacaaggatgtccattgtcaatatgtctattcatcagtatcctggaagccgtactgagggcaatgaaacaagcaaaagaaataggagtataagaatttagaatgaagcaagaatatttttatctgcaggaaatatgataatctatatagaaaattcaagagaattttctaataaactattcaaatgaaaatacagtccaacgaatatatatacacaaaattgggtacaatttatatgtattaattataaccaattagaaaatataacaggagaatgagtcttatatttcaactaaagctataagatctttctgcatacattaaacaaaatatgtgcacgttgcttggttttgatttttcttggttcatttggctggttttagaggaaacttggaaatacacctgagggacatgaaagaaaatattagtgagtggagtgattcaccacattcttaaatggaaaaactagtgttgatttaagaaagatgtcaggccgggcgcggtggctcacgcctgtaatcccagcactttgggaggccgaggcaggcggatcacaagatcaggagttcaagaccagcctggccaacatattgaaaccccgtctctattaaaaataaaaaaattagcttggcttggtggcgggcacctgtaatcccagctactcgggaggctgaggcaggagaatcgcttgaacctgggaggcggagtttgcagtgagccaagattgcgccattgcactccagcctgggtgacagtgtgagactccatctcaaaaaaaaaaaaaaaaaaaaggaaggaaagatgtcaatatcatctcctaattattctttaaattcactacaattctatccaaaatcttgaaggggatttttttgtgtgtgaaatttgacaagctgataatcatcaagactaattatacatttataatacttaacatagtacaatatcgatatatagatagtgaatagatcaatagaaaattagagaactcagaaactgacctatgcatctgtggaaatttcatatataacggaagagtcattacagattagtaaaaagaaggggtgggctcgttcaagaaataacttaggaaaaataggttatccatacaagaataataaaattagatccttatatcaacgcacatgtaaaaacaaatccttggttgattacatacctaagtgtaaaaagcaacaacttcaaataatttagaagaagatgtagaagactatctttatgaactcagagtaagaaattattttcttaaactatatacaaaaagacccttaatgcaaaaattaacagactatttggtttagtaagcaggattgtattttaaaatttttaaattattcataaaaaatgttaaatgtcaagccagaaaccagtatttgcaatgcagtcatataattgacaaaggccagaatccagaatacatgaacactggcaagtcaatggaaaaaatgaccaaaagacatgaacaagttatggatgaaggcagctcaaagggcaaatgagcatttgactagatgattacctcttagtaatcagagaaataagcaaacaaaaaagtatgccacctgtgtattagggttctccagtgaaataaaacaaataggatttacatgtatatagaaagagatttgttttaagaaattaacttccatgattatgaaagttaatatctcttccatgattatggaagctggtaagtccaaaatctgcatgctgggctggcaggctggagacccggagagaagacaatgctacagctcaagtcaaaaggccatcaggctgaagaccccaggaagagctgatgttgcaggtgaagtcccaagaacagtttgctggagaatttcctcttgttcagggagctcagccttttactctattcaggccttcaactgactggacgaagcctgcccaggctctggaaggcaatctgctttactgaaagcccaccaatttcaatgtaaatccccatcagaaacaccctcacagaaacattccggccaagttgacactcaaaatcaactacagaacctccaacacatcagactggccaaaacatttgtctgccactaccaagtgttgacacaaaaggcaaacataagaaactcatactgggctggtgaggatgtagagcatggatccagactggagaacctctcacacatgtgcacaaatattcactgcatcattatctgtagtgaaaaattgaaaaggaactgaaaaacaatcagcagaaaatagacaaattaattctgataaggttcatatgactgagtattatacagcagttaaaggagttagagcaacaggtatctgcatggataaatctaaaaacaatcatgagtttcaggaagatagatacaacaggacagatttccataaaatggaaaacttacaaaccaatactttatattacttaggaatgaatactgtaggaaaatctaaaaaacaggcttgagattaatacacagtaaatttaaggttgtggcatctctgaggagtagggaaagggaatgagatcaaggaggccttcatctgtgtctgtaatgttttatgtgtttttttctaaaggcttgaaacaaatatggcaaaatattaagatctgataaagccatgtgggcgtatgacatttgttatatttctctctatccttattcatgtgtttaaataattctccgaaagcagtttactgagagttcagcatgtctcctgagacatgctaggaagttatgtgcaggagtggagaatatgattcattggaagagttaagtgccctaaatgccagccaggctgtgaccccaggacagaagtagggtgggggggccttcttgcttgctagtgacaatctacaccaaccagcaccacaggagccccaggatgacaaggaaggacaaaacacagggggtgacagatgcaatgaacccctatgtggtacattgagtggtggagaccgggtgtaaaacacacgatcggtgcagggagaccagctatggaggctttggggaccatgataatgaccatccagtgtggctgtacttttctctagaagagggttggcctacatccactccagtggatccacattctctcccaagagactgataagagagtgaaagatttaagtcacctgtgtgggtggccctcaagacccctgcaatgaaaacccaaaggggtatcacagtgttttctggcaagaattggccattgcttaattttcttgtctgatttttcctagcaaccttgtatttgacctcgcctggcatcctgtgtggtcatgagccacagaggtggaaaaggcaacatggtagaggcaggaggaggcaggaggtggaaaagaagggttatcaggtgatgagttcagccatctcttgccctgagtttagttgtgctttgtttataaaaagtgcttttctacaaaaagtatttgatggtacaaaatattatcaatatggcttagatgggtttgagaagtaagaaaaggatcgtggtggtagcaggaaataagacagaaattttccatgggggctccaggtctgaaggcactggcaggtactgcagggtgcctcaagcaggcgtcacttgatagggtcaaaaatcagtaatgtctatgctcatctccaacctctgcagatagaggaggaaatgttgtgaagtatttagatgcattttcttaggtgcgttgtttttgttgaattaggacatgaagccagccacagccagctgtctctccccttcggtgagaaggggacgacgtgaagcacccaagatgtgaaccaggactcaattcacatttggggaacctgatagcctcctcagatgcccccacagaaatccagattgacccctgaggctgagctttaccctctgcagggatgacttccatccagcctgggatgggcaggggaaaccgctgctcacccgaagtgtatttaaggggtcccaacagcaacttatcaacattttttgttgtaaagcacagagagagcagtgaattctgtccattttgtgagcagcacatctggataaggcgggtgccccactgcattcagagcagctctgggaatgaggaaggaagagacaacaaaaggaacaggagccttccaataagcccagacattagacctgagccttgtccctgtcataggctagtcattattgattaaaaggtggacatcagataaacccaagagggacagccccgccaacgtccagagcaatgaggccctcactctgccctcacctctgccagtgtaaattctggggaatttctgaaacaccgtgaatacagaggtgtgactcagcgggaatcacaggaatgtcagaggacaaagcagttggtattaataaattgctttgagtctggaaacaaagaagtggccttctttgtttccaggctgaagtacagtgctgtgatcatagctcactgtaacctcgaactcctggcctaaaatgatcctcctgcctcagcctcccaaagcactgggaatacaggcatgagacaccatgcctggcctggccttcagtttctctgctctaactctgcgttgccctagaaatccttttctgaatttctcaggtattagacattcacccatgacatctgcatctttctcatcttcaccagaatcaccctgtcttaattccttaactcttcctgcttcttgccaggctaagaagctgtattagttatctattgctgtgtaacatgtcaccctaaaacgtggcagcttaaaacaaatgtgtgttatctcacactttctgtgagtcaggaatatggacacggcttagctgaatgcttgtaactcaaggctgctcatgaggctgcagtcaagctgtcacctgaggctttggtcttatctgaaggttgactggcatgggggcatctgtttccaagctcactcatgtggttctgtccctccccacctaggcatctccacaggctgccttgtgacatgtggctggttaccctggggtcgtgtgactctagagagagtaggacagaggacccaaaatggaagccacagtgctttttataacctatgaagatgtgacatctcattacttctgccctattctagtcatagaagcaagttacttagaatgatccacaccgacagggaaaggatgacatgagggtgaggatacagggagagtgggggtcactggggcccatcttagaggctgcctaccacagaatccctaattatttctctgaaaataaaaggaggagaaagagacaccatattctacatttctgctcacctctgtggtggggctgatgtgcatggttttcatggcttaaaagcacactccatctcactgggggtttcccaaatggtcatatgaagagaggaattgctccccagaaccgctggggcacctcatttcgttgatgctttttcttcctctccacggagatgctctgggtagaaggaatgaagccttcaaggtggactctggagggctctcccagaggcttctgtctgaaccagtgggcttaaaaatgagcaagggagaaccttcatgaaaatcactgtcaagtactgtctcagtttgctccagctgctgtaacagaataccatagactgggtggcttgtgagcaatagaaattaatttcttgcagttctggagtctgggaagtccaaattgaggtgctggcagattctgtgtctggtgagggcccacttcctggttcatagacagcctactcctcgctgtgtcctcacctgaaggaaggggcaaggcagctctttagtgtctcttttatgatagtactaatcttatttgtgagggctccactgtcatgacccgagcacctcccaaaggtcccacctccaggtatcatcccactggggatcaggcttcaacacatgaacttgaagacaaacatttggtctatagcaaacacccaccatataccaagccccgtgcttctctgggcttgggggtgctgggataccaaggtaaattaagcctgggctccatggcaagctggtgtgatggttgagagaaggtctaaggggtcagtaaggggttcttgcctggcacggtggctcatgcctgtaatcctagcactttgggaggctgaggtgggccgatcacgaggtcaggagttcgagaccaacctggccagcatggtgaaaccccatctctactaaaaatacaaaaaagtagccgggcatggtggcatgcacctgtaatcccagcactttgggaggccaaggcgggtggatcacgaggtcaggagttcgagaccagcctggccaacatagtgaaaccccgtctctactaaaaatacaaaaaagtagccaggcatggtggcacgtgcctgtaatcccagctactcgggaggctgaggcaggagaattgcttgaactcgggaggtggaggttgcagtgagccgatcatgccactgcactccagcctggatgacagaacgagactccgtctcaaaaactaaaataaaataaggggttctcatcctagtgctattctcagctgagtgactttgggagagtgacttgaccttcatgagcctcagtgttcaaaggatctttatgattatgtttgtgaagccctccgagtcacctctgagtctgagcatccatctaggtgctccatcagcagtaggtattcccagtgctattgcagagaaactctctaaacccacctctcaaactgggccagcctggagactggacccagtgggtctggatgctgacttgagcacacatgtacctcggctcctcaggaaactctcatgcaccccagtggctgggagccactggtctagagagtgagctgcatcaaggaatggtggcacgtgggaatgtgagcaggtgcaggtggacactgggccaaggtggggcgtgtctggactcagggcctcgttggccaactctcctaggacttaagaagggagaggagcccagatagaggagccagttttttttttatttccaacttttattttaggttcaaggggtaggtgtgcaggtttgttacatgagtaaattgcatatcatggggttttggtatacaaataattttgtcacccaggtaatcagcgtaatacccaataggtagtttttctgtcttcaccctcctcccatcctcccccaccaggagtccccagtgtcctctgctcccatctttatgtccatgtctactcaatgttgagcccccacttataagtaagaacatgcagtatttagttttctgttcctgcgttaatttgtttagggtaatggcctccagctctatccatgttgctgtaatggacatgatttcattcgtttctgtggctgcacagtattccatgttgtatatgcaccacattttctttatgcaatccaccatcgatgggcatctaggtctttgctattgtaaacagtgctgtgatgaatatatgcctgtgtgtgtctttatggtagaatattttgtattcctttgggcatatacccagtaaatgggattgctaggtcaaatggtagttctagtttaagttatttgagaactctccagacagctttccacagtggctgaactaacttacattctcaccagcagtgtagaagcattgaggggccagttttaaatcctagtcccttcctgatgctttattcatgctttattcctgcctcctgtcacccgtcttagggatgattcacccagtcccttgctcctggctggaaaaaccttttaaggaaaagtcgctaatctgggtacatctagacttagctttgcccgtggaaagtctcttgcttttcacagccatttgctacccaccctgcacctccccacacccctcagacttcatgcttgagtcctgtttaccaaatgatgggatcctgttttgtcacctcagtcccctctgaggggcagtcagctggctggagcaggaggctgctcaatcccacgctgcaggctcctgcacaaggtcagatgtgcaggccatcatgaagtgagtgtcgagggtggtgtcatcctgaaggttaacactgtagcggggagagcatggggttgcgtgtccctctccctccttgtgcaataactatcgtgggtaattcttttatcgtcttttagataatttttacatccacaaatcagaaaaggaatgagaatcaaacaaagtaatacatgtggaagaactcagagaacagtgtcattctatagcaacaatcaacacagagcctctgctaagtgtcaggccacattctgagcacagcggagacaggattgagcaaagccaccacagagttcacattataaaaatgaaacaaatgaatgacaagtgtcacacggggtaacaagcacgataggggagacagaatgaggagagcatgtttaacagtaagaggttcgggaaggaagccggcccagacctgagtgaaattagccatgcctgtgcccgggggaagcaggtgccagcaggaggaacaccgagcccagcctcctgaggtggagggcatggggcatggtaacaggctgcacaggagctctgctctggagcacgcgatccgggcacaaccaagagcattggtggcaccacttgaacacttgcagccagctcatgacagcatttaaagtgtctttgctgatttgttgaaaacaagatgtaaaaatcactcagtgagaaggtggtatagaccatcagcctaactccaatcctgctcgggcttcacctcccacctcccggctcacgtgccctcgcagcaaacttctcattgctcctcaatttatctccagccccagttcctctgttgaatatcttctgccccatcattgcccctgttttctaagaaccagctcaaacatcaccacctcggtggagattccctcctcctggggttcacccaggaaactccaaccaggaagcaggaggtgggattccttggatgaagaagaggtgagtgagtccccctatgatgtgagctagtgaagggttgtcatcagctcagagtcattccaaaatactcttaatacatttctgttttcattgtatctttaggaattagtggcgatgtttatgccattgcagaaaaaaaaagaatgatgctccatttcacagcttacagagctggtttcacatacacttgaatggtccagctatttctgacagctacaaaacacaggcgcacacaccaccttgccttctgggaagctgtaggagacacattacctcttgacaggataaacagccacacattagagggtaaaggcagggcaagcttcaccccagcacctcctaacctggcacaggcttgaccacatgctacttcaatgacttctttttgagatcaaacacctgcccagcaccccagtctcctgacttcttgcttggagcctgcatctcagcttcctcagcagcaatgaaaaaggaagccaaccccgacctgtagaaatagtgtatttcctcaattccaaggcacacaattgttcaaattttaattattctgaaatcaggatgtgtcttacaattagtcggtacactacatgtggggtttcttttttctttcgtttttgttcaccccctacaagctgttcttaaaacaatggtgtgtcatacaattgatgacatcttagaatcaaataaaataatagttaaaatcatggggtggcaatttaaggtccacccgtgtcagacttctcgaagtcattgtgaaactgtgttttgttctgctttgaatgtctggtggtgtgaacccagagagactggattcctagatccctgaggcctcctggccgagccaggagcatggggcagacaaagggcaaagcatggtccctaccgacttgtcaggcctgccagccctgccactggctttgtgattttcattcctgaattcatagagatggctgccagcaacgagaggtaatctcaggacacacaggcctgggctaggccttggaatattccggaagtcggtggccagagttgtatcaagccagacgggacacatatgggaatacaattacagcaaagcctgcaaggctcagtgaggggcagagggcctggccacatgaggagccagtgctgtgggcaggcctgggtctgagtgccagctgtgtgtcctgcacaaccacatctcccagagtgcattcgtcaccatccactccagatgccccttgaacaaatgaatttcacagttgcaaaaggctgaaaaatgctctgtgacctggcacccccttggggaaccacagtgcattaaaggctctgagaagtcctgcagtaaagaaacctgatgaacttttgtttaagttaatgttttccaaacttctttgatcacagaatccttttattccagtaacaccttttacaatcttaagatgtgaattttctgcagaacagccacctgggaacaggcctgtcttgtgcagaagcctgagggactgggagccaatctcatcactccctcacttgattatggaaagatgaaaacagagagtggagaaatgaagggtaagaccagggaagagattctctctggggtcccaaaacatggccctggctatggacatacttgggggtggggggatccacttgcctgctggcctcttttgggcagttggtattggttgcccgggtatccccggggcagtagctgcagcagtggcctgatgggtgtgcaagcagctagctggtgtgtccagcacggtcttggcacacctggttgttttggaaaggtcttttcttgaacaggaacttgcatactcaaaaacaacagcaaaacacaaggccacactcaccccccaagggtaagtccgtggctcctcctgcacacccaggaaagatcccgtggaaacacagcaccggaggatatgggataagagacaacagagaggagtggtgcttcctgaatttaggaaacatagctgctactttgggccctctagatacttgaaagaaaaaatgatggaaatcactaggtgagaattaagttcttggtgaccactggctgtatgcaggacaaatagtactacaaagtactacaaagaatgcaaatctgtctgctgcacccagcaacttccagttggtaaaaggctatgtccctggagaggtaataactgccactgtaagaaattcctagggtccaatcctgaatccttctctcaacagcaggattctgggaaagggaagccaggttgttcatggacattcagtggaagaattaaggcaattaaatgttaagttttgcagggctggtcgacaagagaagaagggaatcataggtaatgagcacaactaaaatgaaggcacagaagcaagacggtcaggctttgctcagagaataacttcaatgagagcagtgagcaggtgctccagggtcctgggagacagtgggaggtgggtcacagagagcaggctgaggagtttggatctgctcatagagaaatatcttaaactaacagattccacgtcaggcaaggtctcttggcttcaaggagctggcagtcaggagggagcgatctaatgctgggtgggggttgagagcatctggtggaaagagggaggatgtgggcaaagagtttttccataggtggtgtggttgtccgaggggaggccatgaacagagagaactgaggcagggagagggaagcccacaggccttggggttgggtcagaggaggtggtcaaggagggaaaggaaggagagaagacaaggagaaaggaggggaagagggaggcacctcccctctcactggtgtcaggattcagattgtgactgggctttgcatagagcaggtgggcagctgtgacccacacatgatattccacccgaagatgtgtttttctgacatgcacagtaattttcaaaagcaggaaaactttatatagatatctagatttctctagataagtggaaaggcctggccttcctggacctgcacctggcagtgccacctggagctggtcacagctgctcccacaactcctggactgggcgcttcagttggctgtagtccccacccttcctactgcctcacacccaggtgacttcactcacgtccactgacaccgtctgcctgtccccaaggacactgaagtttgcaacctaggtgcagattatgtgcacacagggctgccattcacaggagggagatggtcagtggggtaggagggcgctgaaatccagcttgcatgcatgcccatgttctctgtatgtcccagggaaggaggtcccttctgtatttgcacaaagacatcgtactggctgaaaatggccctgcccgcaaattctcccaaaggtgtgtattctccattggtcacaatgcactatgtagcccatgagaaggagaccaactccggggagctgagagtgagaggagactgcattctcagacacaattgtccagacacttcctttaaaaactacacgccaatgcccaataatgctcagccttggaaaacagtgagtgtctaatcaagccatttaaagcagggagaagattttaattggttgcaagggctggtgtaattatttacagcatacagaggttttccttttgaacctcacagcaatcaagtgcagcagcaatttttctttccctattttgcagatgaggaaatggaagcttatggaggttaagtgattggcctcaggccattgcatttaatactactaataatattaacagccatagtccatcctgggcaggcctgagcatctcacacacatttgctcatttcctcctcaccccatgagagcactgatgctactttttcctctctcccagaagaagacagaggcctagaagagtctgggcagactccaaagcccacccttctagtcccaatgtgagacacccccattaataacaccaaagggcccacacctaaaggcaaatcagtcaactaaaatccaggtctttggtctagaatctgtcactcttattcctgcataatttttaacactggactcatggtgccttgagctgaaatggttcatgcaggatatatcaaaaatctgagcattaaccagagtgtttgtaatgacaaggaatctgtgccttttctatgagacataccagctctgtgtttgactctggtcagtgtaggcgttaacttctgatctgaatcagcaagacctgggttccagccttgccctgcaacccaccagtggtgtggccttggacccatcgcctgcctgtcaaggcctcatcttcttcctctgggacaagggcacagccacagcccccgtgttatggcaacacatgggtcaggctcaggtctggcgcttggcaatcagctgatgatggcagggaggctctgcttcctgtcccaggcagaggggatggcacggcctgtgagtaatgcaggtttgagtggtgagccagttcagagcaaggctgggaggacctttgggcacagtcaggctccagggatgcaaggcgtggctccttcaacttgtctccagcacagccacacacgccaccagtgtggggagggagcccctggtcattttctgctggggagcagaatcgctgatgaagggcccagcgccagtggggaagaggcctccccaacaaccctgggcctcctgcccgctcaagccacttaaaaatccgtaccgtgcccacaaggctttccagtctccatgtctcaggaaggtccaagacagtaggtggaggtgggcacatgacagggctttctcattgcctccaaacaatgccatgtgctaggccatattttctgctcttctagaagcttctgtgtcctgggccaggtgggtgctcattgtgttccctctgtctctgggatcccctcctgctcaggatttagggggattgggtgccctgtgcccacctgccagctcccatttactcacaccaccctgcaggctggaggcttagccacttctcaggaggagcctagaaaggatattggtcgcccagctgctgaacctgccccagcatccttgagggtcttgaaaaatctattttatgctgggcacctgtaatcccagaaatttgggaggccgagacgggtggatcacctgagatcaggagttcgagactagcctggccaaaatggtgaaaccccatctctactaaaaatacaaaactagccaggcatgttggagcatgcctataatcccagctactcaagaggctgaggcaggagaattgcttgaacctgggaggcagaggttgcagtgagcgtgagccgagattgcgccgttgcactccagcccgggcaacagagcaagactccatctcaagaaaaagaaaatcttaaaaaaagaatgccactgtcatgtggaaacacctctaacaaacatgaggccagctaagctggggtgggggccaggtggcagcctctgaggaggcctctgcagtcctgggtggatggttcgggtacagcctgtgaatatgagaagctcttggccactgcacatggctcagttcccatcatcgtgcatcagacactggaagacagtagttggagctgctggacagggctgttttttctcaaccagacagtatccaggtgcctgtccctcagcagagggagaggtgccacaaccggctaccatgataaggagtcagctcagagcacctttgttggggggcctgaggagatgaggtggtatggggataggattctggaggaccctgctggaacaggtagaaggacaagaataactccccactgggactggaggagaggaaggcacatgggggcccttggcagggtggagtagggccataggtaaaaggaaagaggagaaaaggacagatactggggagagtgagagggaagggaggggaggagaagggaggcggacacctccagatctggcatggcagaagtctcctcggaaaagatgagtgcaagatgtgggaggaagagtaggacgtgagggtctccaaagtctgctcgaattttcaggtacaaatgacctcccatcagaatagccccaatctgagttctgcagaggctgagagccaactcaagggcatggagtttctgaagccagaagggaccttgataaacaagaaagcctgaggcccaaggaagttaaagtgatgtgctgaagataacccagccaaaagggggcgcagcctggatccacacacttcatggtgctctacccactacaccataaaaggagagtccaaacatggtaaagatggatggcagactggcagccagtgctgtctccatgacagcactgtcatggagattgacattgacattgacattgacattgtcatggagatttacactgtcatttacaacctggcatgctttagatggtaaagtaataaagcagaattgatgtgtctaaacaaagacctccagtaccttggaaaactgcacacctttgtttagcaattgcgttcacatttagtaattgttttctgagtaatccattcatcattcatttattcctatgtctggtattggcaatttaaaaataaacacaacagaactcccactgtataattgctaaacacaatgacagctataattgaggcactgaaggaaggtcaggggagcccaggagggcggggctgctgctgcctgctgagctgggagggttggtggcaccccttgccctgggttgccatagcagatatcataatcaattacggccgtctttcatgaggaacctggatctttcccaaggaatcagtgagaagtttcagctcacataccatctctgatttgccatccctgggatgttagctgaatcctctcattttacatggaggagactgagggccacagagttcaatgcagggcctagtttagactccagaccagctgccaagagagatgaagggctggtggagaccagccagcaagtggccatgccgcccgctgcagaccccacttcacactctcatgccacccccttgggttcactgacaaaattatgctcacaaaagcagtgctctgatttctatgagatactgtagaaaataacttgttttttctttttgtattactttttattgtatgatacatattcatttcagaaaaactagaaaatacagctaaattggaagggaaaattaaagtcactcataatctaaccactgctatttacatttataccttattggatatattttcaatatctttctaggcatttttctctctgcttatgtgcctgtggtgttatgatacatatgcataggttttcattcatggttcctggctcatcactctcatagtccttgttataatgttgggagcgttaggcctcaggagacaacgtccctctctctgagtttttcctgttctcctttctcctgcccaaggcgggactctaatccgattgtgggtcaaaagaccttcatttcagagcaggtcctgccccagcccctaaaggaagaaatgctgcacagagaggctaggaaaagtctgaacgggcaggtcttgctgggtttagattgtgttctttttgcccaatcacatttctacatggttgtcagtcatgccatgtaatgaaggctccataaaaacccaagacgggccaggtatgttggctcacaccagtaatcccggcactttgggaggccaaggtgggtggatcactttagcccaggagttcaagaccaacctgggcaacatggcaaaaccccatctccaccaaaagaaatacaaaaattagctgggcatgatggcttgtgcctgtggtcccagctgctcaggaggatcgcttgaacctgggaggtgggggttgcagtgagctgagattgtgccactgcactccagcctgagtgacagagcaagagagagagagagaaataaagaaagaaagagagaaagagaaagagaaagaaaaggaaaggaaaataaaaggaaagaaaggacaggaaaagaaaggaggaaggaaagaaagaaggaaagaaaagaaaaagaaagagaaaggaaaagaaaaaagaaaaggaaacgaaaggaagggaaaaggaaagaagaaggaaagaggaaggaaggaaggaaggcaggaaggaagggagagaaaacccaagaggacagtgttcagagagctgagcacgtggagacagactggaaggtggagtagtcatccatgtgccgagtgggtggctgccccagctccacgaggaccagactcttccagaccttgccctgtgtatctcttcatctggctgtttatttgtatcctttaaaatatctttctaacaaacctataattgttaagtgtttacccaagttctgtgagctactctagcaaatggaatccaaagagggggtcttgggaaccccagcttgaagtgggtcagtcagaagttccaaagacctggacttgagactggtggaaagtgggaggcagtcttgtgggactgagctcttaagttgtgggatctgatgctatctcctggtaggcagtgatggaagggaattggaggacacccagctggtgtccactgcttggtgtgtggggaaaatccccacacatttggtcacagaagccttcttctgttgttgattgctgttgcagtgtgagagcagaggaaaaacatgatttgagaggtttttccaaaatggttcctgagtggtaatcacagtaatccatccaccttgtgagtgtgcatgcatgcttatgtatgtgtatatgggattacataaatatggctcacatgtgtatgatcgtatttgcacactcccttgtccacttacttatatatcaaagtttccctcataatgtctgttctgtgtcactatgtaccctcccctgtcctccattccccacaccaagagtattatgagtattaaatgccacgtgggcaggttccccaggcaatgagggggtgggcctgtcaaatgcaggccatgcagaatgccacagggcgggagacgggtgagccaagggagccgagagttccagataacagagtgcacagcaaatgccatggcccgcgtccagcaaccaggagaaacagaactgctgagctcagaataggccaaggccgtgtctgctagcagggagcaagggcacagcctgctgtctggcctcttctgccccatccctccactgggacatggcccagatgagaaagagctgccagacggcaagtcaagtgtggggcgggagaggacaacgttttatgcaagagtggattctcggagcctctgcactctccatcagggctgctggcatggaaaacacagagaaaccatcacctaggacttgattgaactactggacttcccagaagagtccaatttaaagcaaagaggtccagagaaaaaagcattctagtgacatttttatatatttaaaaactggaaaaaagaaaaaataattagaacactgagttcccactgtctatgaaaaatgggcccagccccactgacaaccaacacgcctcacctcacaccttcccctccgccttcgttctggccgtgagccctgagccgaccatgcacatcttaccacctggagaacctcaaactctcctcttgcccacccccaccaagccccacattcaaaaggcttgcctgagaggcctgcccacttccttggcagttctggcctccagtgccctggcaggtgagtgacttctctgtcctgtgtagcatttggtacaggtatgtactgcatttataacacttaccatactggcttggggttgtgacacatcttcaagggagtccctggagagcagaaagcttgtcctattcatgttttgcccatcttgttcctgaataatacctgcacattgcaagggatcagcaatatttccaaccaaaccataaacttctccatctccccttgaagtcttctcgataactttcccagaaactcccagaaacaacaatggctgtcactcactgagaccctcctatgcgttaggccctaggccctgtgccaagccttggcattcacgtgtcacttaaacttcaggtagattgtcagatttagcaaaaacaataataaataataatttaggatatccagttagatttgaatctcagataagcaacaaataatattttagtataagtatgtcccatacaacttttataccaggcatcctatattttatctggaaatcctggccccagggcaaccctacgtgagaaacttgtaggtccattttacatgtgaaggaactgaggctcggagaggttaaacaactttcccacggtaacacctgagatggaatggcaggcagctgacttcagagtcccccaacacggcctttgcttgtctgggagagggagctccaggtggaactggtaaagggggtgaatccattggctgggagatgtcatgagtttgagactatattgggagcacccggcacatggtggccatcaagcaatttttagtctctctctcccttccttcccttgcgccaaattggaaattcccttgagaccctcacacggagtcctctacaaacacattgaatttcagccctcataggaaagcagaaggaagaaggatgatgttgcagaagatcgctgccatttgatttattacaacagtctgaggcctcagagagcgcagagcaaagagaccctggaatgcagccccagatccctggaagagactttacaggtgtcacgttggagagtggagagtgagggggatggtctcaaagaacaggagcagagattatcagagacaccacaaacttgaaaagtcaggatgggtaggacttgaggagaaaaaaaaatcttacctttacaatagcttcaaggaccacaaatttaagggctctccagaggctttaggacagagtcaaggaagtgcttcctggtcgaccctttcaacaaaaactgtgcccctggtctcactgctgcaggcagtgatggtggtgtcaacatctgctcttctcgggctccctccacgcctctgaaaacatggaagtgcttttacccatccagaaagaggggcagctgaaggaaggaggaaagggggtggtccagcgcaggcgcagcctgttgggaaccttctgctctgtctgagcatttgtgatggttgaatgggctggcacgggcgtctaaggcaaggaactgcaagggaggctgcagcctgccctcgtgacccagcactcgtcagatggccggagtgggaatgcgtcagagatttgcctttggacagaactgaaaggatatgaagcagggatgagagaagttctttccataaaaatctgaaaaccaaagggccaaactgatcaacttgcagaacgggaaggactgacaaaaatctcaggaaatcaccaaggtcacaggggaagatcatgaggaaaatgtatgtgaggctcccagcccagccctgccaccacacagtgttggccctgactgccactcacctgggtgccccctggactgcaagcacctggcaggggctgggctttattcctgaaacagtagggggtcctatagcacagcaccaggagaatatatagcaatggatgtccaccccatcctgcaaagtcctgctcaagggccagcccccacatccccagctagaagccgcctctccttctgcaacgttctactgcggctctccacctctcttgggactggaagtgagaagcatttttcacggtggttcacaaggtctcagtgcagatggaaaacagagagtaggtgagttggagagggtggcacagactgaaccccagacaagaaggctgcctggggactcagccctggtctgttagcagttacgggtacccagagcaggaaagcaatgcagaagggtcactttaccccaggccccacctggagcccagctggggctgtccacctgcttcttcatttgtctttcctcccagatccacatcctcgcctcacatcaggaaggcccagtgctcacttttacccaccatccgcctcctcccagttgggcgagtagccctggctgctgcacagggtgcctcccgtatgccaggcactctgctggctgcagggcagcttaacctgcagggcggtcaggacagacagaatctttgctttttcttttcatctgatcagggacttctgtctgatcagaattaggtgtctgggctgtcccaggcaatgcacgacagtcactgggctctcctctcgaagattaaccctttccagatggccacaatggtggcggcagccaagcgcccacctccacataagtcttccctcttctgtccaagccaaatccactcacaggaaaggatctggaactacatggagctaaggagtaataactagagacagttcactaggatctcgtgtggagcaggaaatcaaagttggggactgcatcacactgctgcaatccctattaaacatttgttgttcaaagttctttctcaatggcctgctggaattttttttcattcttcctctttggcctgtcttccagcagtagcaccagcctccccagcttctcccgtctcctcctggacttcctcatagctgtaggcttccatgttctcaactctattattcagaggagttcagctcagtcacgtctgcgccagagctttgatgacccacctgtcagccacactaagggccctgccatgaataaggcctccgtcactgaggatcctgtacccctctgccataaactcagtgacctgactgccagccaccaggcagaacctactagacttctctaaaatagataccgtggcctccttcctcaatcatagtcaaggtctaagcttccttatcaaaggcaggcagtcctgggttttacggcaagaagtgtgcttcctatgtgcaaggtgctgtggggaagggctgagtgtggaggccatgtgtgcaggtctttaggattttagctgagctgccttttcttgcagtttaagaaaaaaacagccagccgttccctccttgtaataaatgcctctgcatatttgaagacagtagttaggtcattcttgagctttctcatcttcaaactaaacaacagtggcccctgtaacctttccttggcaaattgtaaggcccatatgcagaggaaaagcaaaacaaaaccatctgatggggaaggcctcctatctctaaccaagtgtctgttttgaaatgcggtctgcactcagtctttaattacatgtaaattcagtagcttcaagtgtctgagccagtgggagaccaggtgctgctcatcaggccccttggatatgttcatgctgcaaggctgggtgatagcacttggcagacgctaggatttcttctcttcagattcattttggggcaggaaaaggggcttccgtgagtgacccaggagcagtcagctgacacttcctccccaggttccctgagggtaggatgggccccaagagcctccagagagcctgtggcctgctggaaaggctgccctctgcctccacagaagccagcaagagtggcttccagatgtccctggtggaggctggcagcctcatcctgcagccagcgtctcccaggggaggcttcctgctgctgctaactcagagacaggggatctgctaagcgcctgccctcggtgggggtgttctgatcacatcaacttctttcccatggttctttccaggctcctttcccacatttgcagtgtgttatcttgggagaccccatgtgttagtctgtttgtgttgctgggaatacctgaatctgggtaattcttttttttttttttttttttttttttttttttttttttagacggagtctcgctctgtcacccaggctggagtgcagtggtgccatcttggctcactgcaagcgccaactcccgggttcacaccattctcctgcctcagcctcctgagtagctgggactacaggtgcccgccactacgccaggctaatttgagtctgtgtaattcttaaagaaaagaggtttatttggctcatagttctgtaggctatagaagaagcatggtgctgggcacagtggctcatgcttgtaatcccagcactttgggaagctaaggtgggtggataacgaggccagtagttcaagaccaacctggccaagatgacgaaacgccatctctactaaaaatacaaaaaattagctgggcttggcggcaggcacctgtaatcccagctactcgggaggctgaggcagagaattgcttgaacccagaaggtggagcttgcagtgagccaggatcgtgccactgcactccagcctgggcaacagagcgagactccataaaaaaaaaaaaaaaaaaaaaaaagaagaagaagaagaagcatggccaccggcatctgcttctggtaaggactcaggaagatttcactcatgaccagtcatggtcaaaggggagcaggcatgttacatgtgagagagagagcaacagagagaaggatggaggtgccagattaaaaaaatccaatcttgcagaaataagtagagcaagactccgtaccgtggggacggcaccaggcccctcatgagggatcctcctccatgacccaaacacctcccactagggcccacctccaggacccactggagatcccatttcaatatgagatttggggtgaatgaacatccaaactgtatcatccaaggtcagtgcgtttctctgtcctccagttttgcctgccatgagcagctttcctgtgagccagctgtccttttcgtctccagggtcattttcttccttcagtgcccagtgtttggactttaggctgaccttcaggattgtggagtcacagaacaagctcatataagtgtgtaagcaggcagcaaattttttaaaataaagaaaaagttatttagactgtgccagtcagtctgtgtgccatcctagctacaacccagggtggatgctgagtggagggtagaggagtgcatccctcactcttatctgtgcttgtccttcttgcatactgctgaggccaggagcacctagatttgccccagtgggactcacctttttatttatttttatttttatttttatttttatttttatttgagatggagtctcactctgtcacccaggctggagtgcagtggtgcgatcttggctcactgcaacctccacctcccgggttcaagcaattctcctggctcagccccctgagtagctgagattacaggcgtgcatcaccacgcccagctaatttttgtatttttagtagagacggggtttcaccatgttggtcaggctggtctcgaactcctgacctcgtgatccacccacctcggcctcccaaagtgctgggattacaggcatgagccgccatgcctgacctggactcacctttgaggagacacggttttggccaaaatagctgttaagtacaagtgttcaactggtgcccaaccaaagggaaagcaatcttttccaacagtgaagaagaaattggttgtgtctgcttttcaacagcaagggggtgagtctcaaatatggtgcctccattaaggtgttcaataatttcaactacatgaaaaatgtgccttgggaatgacttcagaacttaaccctccagggagaaatgcctctactgtatggcccctggcctggtctcagattggatcataagctccctcattcttgtatccccatgcccaaaactgtgcctggcacttaagggcccataatacatatttttggctttgttgaatagtttaactcattagtgatgcaaagtcccaactgcatatttagagatatttatgtgtgcactacattatggatcgtatgggtgagaagtaggaactcaaagagaataaatcatactttccctccccaaaatgtttataaagccaccaagaagacaggacatagacacatcaaatataaataaaatacaaaaggatgcaccctgacatgccaaatatgtgttcacagaaacaaagttcctcttgccaaattcctgttgtctaaagcagtttttcctaaaacatattcttcagaataccagtttctcagagtgccaatgtgaggaaaagctttggtggtcagatgagtgcagggctgggttaggctgatttctttaccagagggcttcctgaagacttaaagaaatctgtattgagatataatttgtatagcataaagttcacccactttaagtaaacaactcattggcttttagtatagagttgtgtatccatcaccacaatgtcactgcagaatgtttccatcaccacccaaaacacctcatgctgtttgcagccatttcccatccacttccttcctagcccctgacaaccactaatttaccttctgcctctatagatttgcctattctggacatttcatacagatggactcatttactgtgtgatcttttgcgaccagcttctttcatttaacttaatgttttcaaggttcatccacattgttgcatgtatgcactgatggacatttgggttgtttccactttttggctatcataaataacgtcattataaacattcatgagcaagttgtatttgaccatatgttttcagttctcttgggtctatacagaggagtggaattgctgggtcatatggtaattctacattgagcttttagaggaactcccagactcttttccaaagcaggtgcactattttgcattcccaccagcagtgtacacgagttccagtttccctacattctcaccaacacttattattgtctgtccttttttattatagccatcccagtgggtatgaagtaggtatgaagtagtacctaattgtgattgtgattttgatttttgtttccctaatgactagttgttttgagcatttttcatgggttcagggcctttgatatgttgattttttcacaaatcttcaaaaggggacacagtcggcagcagttcctaaatgcgttggaccatggagccaaacttgcaaaagcagctcctggaatgcaagcgcgtacccaaaagctgggaaacattggctggaaaccagcctgtgctggaaatgtgagtttggtgaatgtccttaggtcattacttctgcaaattttgctcaaagaaagggaatctgaactctccacttttgtacattaagataataataataataataattttatcccaagatatggcaccctggcatgatgaatattttgaattaaaggcccttggagacaagcagatgctggaaaaggcttttggttatctgtataaagattggacccaccaaggacagcaattgctttccatctgttccctgaaatctcgtacctggatggaccttttcacaagataatgtctgtttctcaggctcattaaaattcaaaagagaataattaacaggttagtttctgtcccccctcccccaccatctattcattctcactaatactcatttgttgcccctaacaagaattacctacattccccacctcctctctttcctatgaggccttgctgaaggtcaccactgtgcctttacactcaccccccttcctttccctactgcttacctgccccacaagccagtcatggcctctcctctgagccctgtgagaattcttagaggttttatcctcagtataattcaaatgtgttcccttctccaatacccaaaaacatggtatgggattattttttcagtaaggagacaaatagaaaggaggccattcaggtcttctatattttaagaccacaatcttgactgaacctataggtgacccagtgtgcataagctgctatttcctgtcctcctagtcatctttgtgtagaatcaaagacacccacctccttggtacctctcatttgtcacttttcaacacttcctggcaggcaggcagcataactggtcctgctgggtgatccagaccacactctgcaactctttcttctgagccaggctcccctactgtcttttcatttatgtcaaggcaggggaagacctcaaagggctcttgcatcccagtcccacttcccagagaggcacgaggccctccaggatgtggggacaggaactttggggcaagccggggttgtccagaagatcaccaggagggctaaatagtagaaaggagagtcttattggtgatatgtttgcaaactgggaaaagatagcctccagtgtggagcaaagatgctccctcttcaaagagggcaagggcagcttggattttgtgccttacagggtcggtattatataatagagtcatgcatattcagtaggtttggggggaaagctatatatatttatgaggggagccaactacatgggcaatggataaacatacatgtaacacatcccatgttcacttaggggcaggattttagcattaaaatgaggtggaatttggctctttacatcaaaaggtgagctatcagacacaaaggcagtttgtgcacaagctctccaaagggacttgagggctacagctgctcatctggaaagaatccttgtaagaccagtcctctgtccaaccagagttaggaggcgtctgacaatttgcctgattagctctactgttgggagtttaacaagggtgtggtttttcttgtaaccataggaatttagggagttgccacgccagccaagccctaaaccctgggcttataggtaactttttccctaaccttaagatctgtcttagttggtaaaggggtgtctattttggtctctcagatcacactagaaacctctcaagtcctgtattcttattataaagctgattataaagctttacaatttactttgtgattactgtagcttatcgtaaagcaactgtaatcagtaggattggtgtcaagatgggtacacagatgggtagaaaagaattgagaatccagaaatagactcatatttacatggtcaatttatttttgacaaaggcaccaaagaaatttagcatagaaagtataatcttcatcaaatgatgctggaaaaattgagtaactatatgcaaaaaagaaagaaaagaaagaaaaaagtgaaaacctccacctccgtcattacttcataccatataaaaaattaactcagaatagatcatagacataaatgtaatagctaaaactataaaactcctaaaagaaaacaggagaaaatagagaaaaccttggtgatcttggttttggcagtgatctgttaaattcaatagataaaacacaaattagaaataaggtattgactgaacctcataaaaataaaacataaacttttgttcttcaaaagacatttaggaaaatgaaaaggaaagccccagactgaggtaaaatatttgcaaaacatatatataataaaggttttgtatccagaatgtataaagaagttaagaagaaaagcaacatactttttttttagttgacaaaagatctgaaaaagacatctcaccaagtcgtttgtaggactggcaaataagtaaacaagaagaggcccaacacctttagtcattagagaaatgaaaactacaaccacagtgagataataacacccactagaatggatgaaattgaaaagtctgaccatatcaagtgtttgcaaggatgtggaaccaacaggaactccattcacagctagtgggaatggaaaatggtttgaccatgctgaagagcattttgttgtttttttaaaagttaaaaatatatctaccatatgactcagtcattccacacttggttatttacaccccacaaaaaatgaaagcatatattcacacaaaggcttttaaacaagtgttcataatagctttatttgtaattgccaaaaaccgaaaatcacccagttgtaccccagcaggtgaatggataaaccaattgtgacgtagtcatataatggaatgctaaccaataatttaaaaaaggaacaattgatacctataacagcattattgaatccaatagaatgatgctgaataaaagaacatggacaaagaaagagcacatactatatgattttagttacataaaattctaggaagtgtactaatctatagtaacagcaagcagatcagtatttgcctattgggggaaggagtcggacagcagcaggggaagggttaaagtcacattttagttttaaaatattcagcatgtattttgggctacaaaatagcacaaggaaactcttgggtgtgatggacatgttcattatttaattgttatgatagtttcagagacataaacataaaaaacttctcaaatacacacttccattatgtacaatttattatgtggccattatacttcaataaaactgtcacggaagaacgacccttatcttctggaggtacatgctgaatgtcttacaaataaaattatctaagaactgaaattggcttcaaggtaaagcaggaatggggtgagaagtgtgtgtgacgtggacacaagggtgatatagaagattggcatcaagtgacagaagtagacggtagattcatttttatatatgtttgaaatactacattacaaaatgccagtagaaaatctgagtctaaccctaagaatgcagtacatcctgctgccatgtttctttctttagagctgaggagaggcctctttactttggtcggaaacctcattaggtttgatttagttcaataaaaatgtgtataggtgaaatagtccatacgaattcattacaattgatgtgaaacaaaattaattaataattaatccatgcaagtcttttggtagcctgcattttatcaaagaagggacccatggcaaaggctgggaagggacctttaacaggggagcatgagttccacggcagagttgccctcaagtaatgctttgtagattggtacagcacatgtgcatcaaagtagtgaaaggattatgaaatgtgaataaggagttagaaggtggaccttgaagtcctcctgggtacccatttccccaagagtgagcatcattattcttcattcccatacttctacaggatcaatgttgcagccacagtaggtggaaaattccaactctgctaacagttgggagcgtgtccctctaatgagaggacctgttcatgcaattttcttgatgtctggtgaacgctcccacattatatcttcaaaagactttactacctgagagggtttcatgctaactgctgagtaaaaccacccagtgctgagcacgcagagaagggagtggggatacaggtccaccacagcccaggctttggagtctgccaaagcagtcagacaacggtggtcagaaaaggtgtatgagtcactcgactgactacttaaatccaaaggaatttgtttacatggaccaatcgttttagtaagatggtttgttatgtgcctttataatttaacatattaattttatttagacaatattggaaaagataatgcaatccggtgatctcagcaaaattctctcctctataaaaataatgagaaaagtgacaaaaataatcagaatcaactttttagaactctggaaatttaccaaagtgttgcagccatccaaggattgtttgctcaagcaaaacaactgaatttcacctagaatagtgaggtttgtgacattttaacttgccccattcgcatcaccctttctccagcttcatggcagcctcgaaaaccagcagcccccagtcacagagaaaacccgtctagtggttctctgaaagaccccacttgcaaggctgtctttatttaatctgacttggagtttgcccagtgtgaaaagccatttcttcaggggcatttgttaaaaacatttagaggcaattgtttaacttcacagatgcttgagatagtggataatagttgcaacaaacaataggctaattaaaaagcttaaagtgaaaactggagaatggatgttcataggggctttgaaaagctctgacatattctgggaaatctggaaggccatgagcaggagtaagataggctttgcacatgcacagagctgtgtgcaggcttggaaaagatcttagaaggtcctaaaccctcgtcaatggctcccttaaagttctggacaagaagatattgtcaaaatctaagtttaaggtggaattgtcaactgcttggatgagtgtggaagacattccccaacatgcatgtagagcacctcagcaaaaacttggagatgtaaaccaaaaagaaaaatctaaggtcgtcctaccccaaccatctgaatggaaccctcctctctgtcaagggcattccaaagtttacctgaaaaagaagttcaggccatgatgggaaggcagagctggacaaacctggtaataccctcctcctttctggagttactaacagaacagactctaaatctgataagaaacatttacaatctagtctgtctgaagcctgctacctggaggcttcatttgcatgacaaaatcttggtttccacaacctcttatcataacccagatattcctttctattgatagtaactctttcaaccaattaccaatcagaaaacctttgaatccgcctatgatatggaaacccccacttccacttgtcccaccttcctggactgaaccaatatacatcttccatgtattgattgatgccttatgtctccctaaaatatgtcacaccaagttgttacccaaccactttgggcccatgttctcaggatctcctaaatgctgtgtcatgggccattggccactcatatttggctcagaataaatctcttcaaatattttacatagtataactctttttcattgacagagacttactagttcctgatccttaaagaaatttctctccaatcattagatgaccattaaactaacaaagcagagacgtcagtggctacacaagacaaagaatacagacttataacacaattacatcagaaaagttactaaaaaacaaaaacaccaacaaactgtaaaaacaacataacctgaggagtagagaaagaatctgattttttaaagttgccacattgcatttttaatgtccagttttaacagaaaattacaagacatgtaaggaaacaagaaaatatgtctcatacacaggacaaaatcgattaatagaaactgttccagaggaagcccagacataaaacttattagaaaaagtctttaaatttagttcaaagggttaaagaaaaccatatctaaataactaaaggaaaggatgaaaatggtgtttatctaacacagaatatcagtaaagagatagaaatgataaaaaaaaaaaagaatcaaataggaatgctagagttaaaaagataactaaaaggaaaattttaagaggagctcaacagcagatttgatcaggtggaagatataatcagcaatcttgaacattgttcatttgagattttccagactgagaaacagaaagaaaaaaaaattatgaagaaaaatgaacagaacctcagaaacctgtagatctctatgcttgtttttctcaggtttgtcaaagatcagatagttgtaggtaagcggcgttatttctgagggctctgttctgttccattgatctatatctctgttttggtaccagtaccatgctgttttggttactgtagccttgtagtgtagtttgaagtcagatagtgtgatgcctccagctttgttcttttggcttaggattgacttggcgatgcaggctcttttttggttccatatgaactttaaagtagttttttccaattctgtgaagaaagtcattggtagcttgacggggatggcattgaatctgtaaattaccttaggcagtatggccattttcacgatattgattcttccaacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgctcttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgcaagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctgggagaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacactttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcgaaggacatgaacagacacttctcaaaagaagacacttatgcagccaaaaaacacatgaaaaaatgctcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttttcaaaaaaaaaaaaattttgtctctaaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttctgaatcctttaagttgatcagttgacaggaatgcatttatgatttttatcttttcttttggggttacttttcagtttgactttgaaggatcactttcccctgtcattgcgcccaaaaaagccttccgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggttttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttcttttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccactgcacccggcccagttttttcttttatggttagttctttctgtatctagtccaagaatttttaatttagaataacacactgtattaagccttataaaaacaccagtaaattccaagacctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaattgtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtaaatttgtttgtaggttagaaactgccaggaagtcctgagatgactgtcttttccatgatatcatatagggaccttgtaaatacgtttctgaaatctgccttctctgaaaactatggcatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgccttacttacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatttttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgcttttttttttttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccatgcctggctaatttttctgtatttttattagagacgaggtttaatcgtgttacataggatggtcttgatctcctgacctcatgatccacccacctcggcctcccaaagtgctgggattacggcgtgagccactgcgccaggccgccaaggatgcttttaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttgggacccagttgttggaacagagctgaatcctggatgtttcttttgtttttttcacctttagggttagggcaaaatttttggttagattcttcttcttcttctttttttttttttttttttttgagacagggtctcactctgtcacccagatgggagtgcagtggtacgatcttggctcactgcatcctctgccttccaggctcaagcgattctcctgcctcagcctcccaagtgcctgggattgcctgggcttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtactgtggcagaaaacatgaagcattttggagaatatggaaaaacgttattccttttttttttttttttttttgagacacagtctcgctctgtctcttaggcatgatcttggctcactgcaacctccacctcctgggttcaagtgattcttctgcctcagtctcccaagtaggtgggactacgggtgcgcaccaccaggcccagctaattttttttcgtatttttagtagagacggggtttcaccatattggccaggctgttctttaactcctgacctcatgatccacctgcttgggcctcccaaagtactggggttacaggcgtgagccactgcacccggctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttcttctgtgtatagttctgtgaatttcagtacgtgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgtcatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttctggtttctaccttgtcttgtctcgtcattctcttaatacatcaaagagcaaaagtgtttaattttgatgaagctagtttatctgtatttttctttaatggatgttgcttttagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctggttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcctgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtctttgccccctgcccttctttttctttactctacgttttgctctgcttcatggtgagaagtgcttcagagtccccccatggctccaaaacagacatacagaatgatgattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagactttttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtaacatgtatcaaaattacattgttttaaaggcagtattctatatagtattccattgtatggatataccacaatttatcatttcacctgatgatgggcatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttacttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatgtggagcaaccgaaactctcatacattactggtgggactgcaaaagtggcacagcactttggaaaactgtttggcagtttcttgtgaagttaaacatacacttatataagacaaattccaactccttggtatttacttaagagaaatgaaaacatatgcctacataaagacccgcatgtatgtgaatgtctttggggccaggcgcggtggcataatctcagcactttgggaggccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcaacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagatgtgaatgaatctcaaagacttatgctaagttaaagaagtagcacaaaaaagactacgtatcatatgattcatttacatgatattgtaggatagacaaaactgtagagcaagaaaacagatgaattgtttccagtgctgggtgtaggaggaaaggattgactacaaaaggaacgagggagctttttggtatgatgaaagtatactatattgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcaagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcagtttctgatgaatcctcacagtatttaaccagaataactgtaggtaagttggtgcaatgttgcctctggaatcaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatgcatatgcaggttctgcagggccaattgcaggacttgagcatgcacggatttgggtacacatggggtgtcctaaccagtcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagaggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctcctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaattaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaagatgaggatattatatgggatgtatgttaaaaagtaaagttttaatgaatattaaaagatgtttttgaagtcttatctaaagtatgttctaaatgaagtttctgacaggttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctcttttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcatgaacccgggaggaggagcttgcagtgagccgagattacaccactgcagtccatcctgggtgacagagcaagactccatctcaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtactaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccactttgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtcccgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaacattaatctgtatttgaatgtgattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaaatagtgaaaactggctgggtgtggtggcgcatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaaaacaaaaaaaagcttaataatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagattttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatctcggctcactgcaacctctgcctcccgcattcaagtgattctccagcctcagcctccccagtagctgggactacaggtgtgcaccactgcgtctggctagctaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccatgcctgctttggaaaacatattttctctgtgctagtatagtcatggcacatcagcctatatatcctcatgttcagcaagtgcacgttaactgcttttgaaattattattataataaatctgttactcaggtgctctcatcagatgttccttcaggtacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaactttaacaaaccacgtgtgttagcaaaatgtctttggcttttgaggacataattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccttgatacattataagactcacgtgcctatgacattccagagctattctcttgggacacttctgttttaaaattctctcctgttcttttatctgcttgtctctatcatctatcattcatctgtcactgttttctagttctctttactttttttatggtactgttttgaggggaaccatcacccacacttagccacaggctgctgaagatctgaattagttgtgatttccctattaactgtttcctctccacatgtacccagttattagtcacctgtgaataaaaagatggagtgacagaagttgagtttagagcataggatttatgagcatggcctctagagccaggcatggccatgctgtgctgggtgactttggttaaattactttacctcttgttgcctcagtttcttcatttgtaaaagtaggcatacttcatgggatggtgctgtgtatcaagtgaattatttttacatagcacttagaatactgctcaatacatagtaaagctcagtgcagtcagccattattattagtagagttcattgattctaagatgcaagttttttcactttttaatatctctgaaatcagttgtgtattttagtgaacaggcgtcatagtttaattggcagtgctttttctttcttagtttctcatgaaataatgatacatcttatcagtggcatcttatattcaggggatataatattgttctcattataattttgttacttgcgcaaagttgaagtgaattatgtgtaagatttcctctaaaaaaattctatgggttgcaacagactcttggctttgaattttcctgatcccaaattaatgttgcggttgtgttcccagagaatctttaagacagcaaaatttttctttccagttagctagaaaagcagttatgtgtgtccagttaaggagggagtatgcttatgaatagctttgtctgcagagaaaatgtttgtcagttgtcagcctctgaagggatatttctgtgtcttcagatatagcttgtataggtgtttcttagttataaatgccctacttccaaaatttctgttagttttttttaagtggctatatggaatgttaagctattttaacataggaagaagttgaagagtggtgtatgaatttcacagtagagccaacagaaaccattttaaccttgaacatacctgatacataatggtattagtcctataaatctagccatcatgtaagtgaaaccaatctgtatttcccttggagacaccatgaaatccattcacctctaacacaaggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttttttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttatacagtacaccttcttttgaaatacttacagatgatatttcaattgctctttgctttaaacattttcacatgttggtttttactttaattacagattgctccaattgtgtcagcgaactatggctcttcctgtaggacgaggaatgtttaccttgttttcgtaccatcctgttccaacagagccattgcctattcctaaattgaatctgactggtatgttaaattctgggctcaatgagaaaggaaaatgattaagtacatgcattaagtgtagttctttaaattagttaaaacaaaagaaatgctccctctatccccagtgatttaaaattttcctaatagctgctgtagtggttatcaaagctcaaatgccatgtgaaactaaactttgagagaagcagaatatagttcattactcatttttgctttttaatgaggtgatttcaagatctaaaaagtcacttggagaagttcagaaagatattattgataacgatgagacttgaattttaaataatcttaagtttaatatgtaaaaatatttagttttaaaatgtcttacgtcatagtttaaacagatgatcattgtataaatcaagaaatgtactaagcaaaaagagaaacaatggtcacttgcagtactcccactcttctgcatcactccttttaacattttagtatatatgtttactaagtttatttccacatatttataattttatatttgtttaattatcagaaaatttatatctattttagatttttttaaaaatttacagtgaacatccttttatatctagcaaataaatgtatgtgtttataattatgtgtatgtattgtatacatgtgtttttaatcaatacactcatttttatttgcttcagagtatttcattcagcggatataccatagtttatagaagcagcctggtattgttggaaattacagttttttggtattataaacattgttggggcgtattcgtcctgtgtatttaggctaaatgcttagaagtagaactcttaggacagcaagatgaatggttttaaggaacatgtcaaattgcctttctggctggcacaagtttttatttctgccatatataactgtagttatagtcttgattacaatgaattttatagtgcatgtccccctaatgctgatttgaatgtgttctaaaggtgacaattacatagttgaaattatcactgaaactctattatagtatatatggttttgtgaaacctatacaaaatgtatgtataatgtttgttgtagtagtgtatagtatatgtggtagcatataatgtataatttaatatatgataaatagtacataatatatgcaaacataattatacagtattttaaattgcatactttaaaaaatccagagttccactcagatttgtgaaaagcttgtgctttgagcagcatgcaggaaatgagattgactaagtgaaagaacacattcccatctccataccatgcttattctgagccctaatctcactgagggacatagtgagcagagtggcttttaatatttaaattgtctcagaggtaaagcacctatggcaaaattttaacaattattgattcttgatggaaggcatggtatatagatgttcattttagtagtctttccaactgtttatatgaaagatttcatatactaagtgcagattaaaaagaaaatctaatgcaaaattggcaaatgttaaaatgtattcaatctgggtgatttagcactcaagtgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtctcttgcatatgatgaatgaatgtttcagaaaggtcactcagttttttcatattgatatgtctgccttttttgagaaagtacaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactttgcatctacttaaaattattttacataacatcttagaactctttaaaaatggtatttttaaagctgcagtgaaatggataactttatgcagtaattaaaatatttatgttaattattttatccgtgacttaagacaatattcaaaatatatttaaaaagattcaatgtttgctgtgtataatgtagatcaaaaagaaaagaatcaagaaaaaattcgtagggaacatatagcattgtgaacatataatttacattgttcttaaataaatggaccgtaaaagtataatctggtgaatgcccttttgaagttcactgggtgactcaagtctataaaaggatgctttttacaaaactatctctaagcattttaaacaatagcatataattagatatctatatctgtatgtatatatagagagagagagaaaaaaagagagcaaagggggcatatataggtaagacctgtagcagatttattaaggttcttgtttcctttttttttttcttttttgagatgcagtctctgtctgctgcccaggtgggagtgcaatggcatgatcttggctcactgcaacctctgccttccaggttcaagtgattctcttgattctctttagaaagtgataatctttctaaagcataaatcagagtacgtcacttccctggtcaaagccatttaattaatgatctcccattgctttttttttttttttttttttccttgagtaaggcagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaaccttagcctcccaagtagctgggacaggcacgcaccaccaggcctggcttttgtcttttcttaagatgtcatttttccttaatgtctaggggaaaataaaggatagaacatttgaaattaacatcagtgtcatcagatgttgggatttataacttgtatagtttaacagtgatgttagtcttcattttggtttttaagctctctgtttgaaagaaaaaatgagtgattatcccagtcatctctgtataatgttaaattggtatcagttatctcattatatagcctcatacattttaacaaaaaggacaatgaactgtttagacagtgaaggtttttccagttccattaagtttgactcacatgtacaaaagttttaagtggtcatagagacctaacgttccaggcattatggggttaatggttttgaatgtagaaaacgtaactaatcttagtctcaaagatctaaatttaacaatcttggttttgtggatttttattctctcaatgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaaggtgagacctgtgctcccagtgcctggctttgtgccttggctggctattgtagtagctcctaattgctctatttgctcttctttcttcattcttgtacttctaagtccatttgtctcatagtacatggaataatctttctaaagcataaatcagagtatgtcacttccctggtcaaagccatttaattaatgatctcccattgctttttttttttttttttttccctgagtaaggtagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgctttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatcttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccagggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaacattcccaacaccagagggcaaagggggatcgaccattgctcttaatatacattctaggagctggtgtgatcctgttcacttctccagccctaggtggtaccactgttcttcgttttttttttttgttttttttttgatgtggagtctcaccctgtcacctaggctggagtgcagtggtgtgatctcatctcactgcaacctctacctcccaggttcaagcaattctcctgcctcagccttctgagtagctgggattacaggtgcatactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttatttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctgtgggtttgccttttctggacctttcatatgaacggagtcatacaaaatatggtattttaggatgggcttctttcacttagcctgataattttagggttcatccgtgttgtaccatctatcagcaatacattcctttttattgttgaataaatgttttattttatgaatgtacattttattcataagttgatgaatatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaaccgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcttgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaaagtgatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatcctgctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattggctccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaataaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaattttttttttttttttgagagtcttgctctgttgcccagcctggagtacagtggtgcaatcttggctcattgcaagctccgcctcccgggttcacgccattctcctgcctcagccttccgagtagctgggactacaggcgcccgccactacgcctggctaattattttgtatttttagtagagacagggtttcatggtgttagccaggatagtctggatctcctgacctcgtgatccacctgtctcagcctcccaaagtgctgggattacaggcgtgagccaccgtgcccagcctaaaaattgtttttatagatcattgttataaatgggttttaaaacacattttgtataatattcattgagttgatggtctgtaaaatgcctttttttaacttttagaaccttttagattgtttctaataatcctttgttgttatgtataaacattacactgattacctttgtgtgtgatttttttctttaatttttattatttatttatttatttagagacagagtctcgctctgtcacccaggctggagcggagtggcgcgatctcggttcactgcagcctctgcctcccaggttcaagcaattctcctgcctcagcctaccaagtagctgggattacaggtgtctgtcagcatgcctggctaatttttgtagttttagtagagatgggatttctccatgtcagacaggctggtctcgaactcgttgacctcaagtgatccacctgccttggcctcccaaagtgctgggattacaggcaagggccaccacgcccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacatagtatttaacagcttaacaacgtaagtaagtgacctccttattcattatcatcattcgaacatgtttcaccacatgtgatgtgtggatttgaaagtaatgaaaacaaaatgtaagatattttgttgttgttgttgctgagatggtgtctcactctgtcgcccaggctggagtgcagtgacctgattttggctcactgcaacctccgcctcccaggttcaagcgattctcctgcctcagcctcctgagtagctgggattacaggcacctgccaccctggctaatttttgtatttttagtagagacagggtttcaccgtgttggccatctggtctccaactcctgacctcaagtgatccacctgcctcagcctcccaaagtgctgggattacaggcatgagccagcacacctggccgagatgttttaaaaaaaataataaaacttttttttgaatactcttaccttttttcctttaaaatttttttctactacttggtaatttttttgataagactcaaagtttcacagtatttcaatatcattgcttataaagacttaaattggcaatttaaaaagaactattttgggccctttttttttggtaggtaaacctacagttgtggacatcatttattatagtgtcataactttctgaatagttatatcccattcatatctccagtgcaacttgctagaaagttaactctaagatttttatgagatgagattttgagaagctagtttgaactgtgttgcttttctttttacaggacggcctcctggtcctgaaatggaatactgcactgacagaaagtcatactccttagctgctggcttggccctgggcatggtctgcttgggggtaagcatagcctatgccttcccatgcttcagttaggacatctacatgttgagacaaataacgttgacacctaaacctgaatattgtcccttactacgacttaatcttctgcccagctctcttgtctttttggatatttttcaaggtaccagatttgcaaattgagagaaactgtggtcaagagtgagactttaagatttcttttcctccagcttacagtgttcatgaacaaactaaagggaataaagttttttttaaagtgttcaagacatagaatgaataagtgacagcccactatgactgaaaacagagaatagtgaaaatgtatatgatcaggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagatcaggggttcgagaccaacctgaccaacatggagaaaccccatctctactaaaaatacagaattagccaggtgtggtggcgcatgcctgtaatcccagctactcgggaggctgaggcaggacaatcgcttgaacccaggaggcagaggttgtgatgaatcaagatcacaccattgcactccagcctgggcaacaagagtgagactccatcttaaaaaaaaaagttatagtggaaggaattttttctcatgtgtgttctgaaaatccacctcgtggttgaccatctgttagggccttgaattcacattggcacgtgagctaaagaggctggtggtataatggaaaataatcagctgggtgtggtggctcatgcctgtaatcccagcactttgggaggccgagatgggtggatcacgaggtcaggagatccagaccatcctgtctaacacggtgaaaccccgtctctactaaaaatacaaaaaaattagccaggcatggtggtgggcgcttgtagttccagctactcgggaggctgaggcaggagaatggtgtgaacccaggaggcggagcttgcagagagtcgagatcgtgccactgcactccagcctgggcaagaaggcgagactccgtctcaaaaaaaaaaaaaaaagaaaagaatcacacagggaattgcaacttgaattctggtcctaactagtgagtcaagtcatttaactacattattgtctattgcttaatcagcttcatggattgttgaaccagatggccgtgttttatatatagccctgcaacttactataatagctgtataaccttgggcttaatccctctttgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgaaagtattcagatatttacagttcaggtttcaattatataactaatatttttctttattgttaaatgtaactaactctaaagctcttatgtattttaagacagtacttaaagttgaacattcatgtattaaaacttttatgagaattattaatatttattaactcatgattaatgtttgctttaagttggaaataaaaaaaacaaaacccgaaataacctgctttgaagttagttcatttttatatttgttatgggtatgtgttatggatcttcctccataaaatttcttttcactcgtctgttattgtcttttccagcatggcagcaatttgataggtatgtctgatctcaatgtgcctgagcagctctatcagtacatggttggaggacataggcgctttcaaacaggaatgcatagggagaaacataaatcaccaagttatcaaatcaaagtaagtacacagcaaagtaatagatcaaaagtctggaagctgggaagttaattggaaaatactagtgttcatcctgacattggtaaatatgttaattttaagcatacttatcagaggaattttataaaaatttagaactcttttacatgcataaactcttctttcaataggaaggagataccataaatgtggatgtgacttgtccaggtgctactctagctttggctatgatctacttaaaaaccaataacaggtatttctacccactcacccttcctcccacggtgatagtgtgatatcctctctgaccttggttgtaaaattcagttatctcatgtgtttctttcccctgtgctggattaagctgattttcgttctttcaagtactgtaagtttttgaaagaaaactggcagtatttgaagttataaagattttacctagaaataatgtatttggctattttaattgtatttgacaatatagttttcaatttctgttcatttctgttttgtagttgatgtcagtaacacccaaacaatgcccatgtttgttttcattaatttagcatattgctgtgaggactggttaagccagaaatacttatcattagtgtgatcttggctaccatgtaaaacaatggtttttgcctacttcaagagcttttgtaattaccaaaccgtctaccttcctaacttgctatattaatgctgatgcttgaaagtaagatctttggcatttatgcttacacgttgcatgaagagtaagttgagtacaacatgttatgccatgtattaagtctattaattaaaaacaaattctaagattcaaggagcttttcagtgttccacatttctccctttagaaaaagtaaatgtgtgcagaattaacaaagtgtttaaaaatagatatttattattttactatttggatgaatgtgtagggcagtgcttccttggcactggggatatttcattgagcaaaactaaaaatatcttccctcatggagtttatgttatagtaagacatacgtgtacctctataataactattacgttagaaggtataaagtattgtgaaaaatatatagagcagtagtggagtgggaagaaatgttttgaaatagagcttgagattcttgattgtcttgccctctacttgaacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaagccactgtgttttggtttgattcatcccatagcaaaaggcaacttcagcaggccctttctgaggctctggaggggccctggcaatgtatccatttggtcatttgcttttgacaaaagcagacattttagctgtaattggctaaaattctgatctctttctgccctcatgttgggtggtggtggagtggatgtgggcattttgaggatccagcaaaagaagaattgagttgagtcattgagtttgggttccatgggatttatttatgtggtatggagtcatttctgtgtattttattgctagctgtccctgtgtaaaacagattcagaatagtcttcacctccctcgtgctgatttacctggtggtgtaatgtaaatatgcaagaccatagattacatcacgattgtgtcacatgacatgtgcatttgcaggaacatggatggagctggaggccattattctcagcaaactaacacaagaacagaaaaccaaatatcgcatgttctcacttataagtgggagctaaatgatgagaacacatggacacatcgaggggaacaacacacactggggcccatcagggttggaggatgggaagagagacagcatcaggaaaaataactaatgagtactaggcttaatacctgggtgatgaaataatctgcacaacaaacccccatgacacatgtttacctatgtaacaaccctgcacttttatccctgaacttaaaataaaagttgaataagaaaaatagaaatgtacaaagctagaaaagagtgtagctcatcccatctgggaattattccaaatcttacagttcatacataaaaatagtttgataaagattttcctaagtgtgccaagaatcctgaaaacttatcttccattatcgatcctgagctatgaagccagaagaaaaatttaaatctatcaataataaaatactagagccaaaatagtttattattctcttctctcatagactatgatattacaacattattgaagaggcaatcaaagaatatgcaggcaaaaatgttgggaaaggagtattacagagataggtcaggaatttgtttaattaaaattgctattttactgagttttacatatgtttagtggtagcggtagctagagtagactttgctggagtctgggccattgagattggtattattaaggttatgttggcctcatttgctcttaccttctggcatacacaggatacatctcacttgatttctcacaagtctttggtacccatgaccactcccacctttttacaattttcacttttgctggcttctctggactcacactgtcaattttcccctctggctaactgttctcagtcatctctacagaattctcttcttctgggtccttgtgttgttgagggctttatcctagggcttatttttttctctctgagcaagcttgtccacccccattgcttcagtcccacctatctgctgacaactgctgattccacatctccagctcagacctctttcctaggctctacaccaggaattggcaaactttttctgtaaagcgatgataacaaatattttatcggcttgctggtcattgtactgtctctgtcacatctgctcaactctgctaaggtggtgcaaatatagccacagaaaatagtaaaagaatgggtgtggccatgttccaataaaacttgatttataaaaataagcctgcttcatgggctatagtttgccaactcctgttctaaaccagaatattcaactcccttctggaaatttccacttgggttttctcaagttcctaaacataacattgtccccagccaatttcatcttattccctcctatgcattccttcttaatgaatgatccactgtccaccagatgtccaagccagaaattcaggcagcatacttgatttcattccccacattcaatgagtcacaaaatcatgtcaattctactttctcaacatccccctaatccattcttttttctctttctccactgccttctttcaccccctctcatctctcacctcctatgacctcctcactgtgctgcaatcagagggatcaagccacccttggattttaaaagccttcagtaacagtagtccctgcctttctttggctgaagtctaaacttcttgaaacagagtgagaagcctgcgcaattggaccatttccccatgttagccaaattcctctcatctgtctgctcctcctgcctctgggaccctgcacatatatttcttctgcttaaagaatgtgtagcaggtgaagcaactatctgaggccagtataccatgggcagtaagaagaatttaccaagacagttgtagataaaggcagatttattgaagaaagtatgaaaatatgttgcaaggcagcaacaggcaggccagcaagagaggaactgaatgccaagagacaaaggcttgctgggggttttataggatgttgcttttgctgcgtgctgaagagagctttgtgcagtactgataacaccaaggttgcagtgggataacctgcatttttccatcagctgagggcctgatggtagctgggcacaggaagattgtgagctatttgtgcaggagggctatggtcctggaccatgaagaaaggcaaacttacagcttatctgctttctctttcttttttcctcagtgtcaccagcctgattccttttgcctaattaggactccacagaattattctcctttctcatccttccagctgtcttctaagtctcaacttggatgttacttcctctgggaaatgtctcctcacctctcaagactgtctctctgtgcaccactacaacaaatgggacctgggccacttcacttttacaattccagtttacagacctgcattgccccaaacccatgagaccaaaaactccctgagggcaaagatggcctcttatttactcttgattccccagcacctagcacagcactaaacactgtacccactgaaagaacatctgaaggatgagagtttatagcaaaagtggtttccactgacattcccttctctcttccccaactttggattgaggagcccaggagctggtcaggtggcaagataagatgagaaaggagaagtcattacttggggcctctgttttgctggtgttttgctggtgtgtggagatggtgggtttcccttgaatacctgggaggcaggagcaggcatgaactactccagcctctgggttctggacccacatggagggctgctgctctctggcacccatcagtccttaaccatctggtctccagccagggaaggagtgtggtggtggagaagcctctctgtcccacccactcatcccaggagctcacgagaatcagccaaagtccgagttctgcaccctgagttaggaactctataactttagactttccctgaaatttgggaattctcttaactagtatgaaagcagttacatcatcctaggtcctcctaaaatagacacatgtatccaaatataggcacatgtgttgcaaacataacatgtatacatatataaatatatacatataatttttgttttgaaataagtataaacacaacaagttacaaatatagtactgagagatccttgtgcctatggccccgcctccctcaggcagtatcttacataactatagttcatgattacaactggaaagttgccattggcacaatatcagaaactagtctgcagaccttgctcagatttcaccaggttttttgtgcactcatttgctttcctgaaaatattttaaggtttttctacatgacttatctccctgacatactgtgagataagattttttttttctctgaatgagcttagagaacaatcaatgtgagagatgggaaggatgatttggtgcaactctgttttatccatggtgagtctggacctcagagcagaaggaccctcgtctctcctctggggagtcctggtgccacctcagtgcaggctgctaagttatccgggtctgactttcttcttctctgctaatatttgtcttaagcatgtaacacagccatgcttattaatgatgaggagacagccaatgaaaattaattttttcaaagatgaatagatatctagattttttcaagcacaactcaattaagaaaatatcacctcactgagccccaaatgagttaggtctcactgagaaagtgtctcctagtgccaggcaaagtgcctcatatttgtaatcccagcacttctggagactgagataggaggatctcatgagcccaggagttcaagaccagcctgggtaacatggcaaaaccctgtccctacagaaaatacaaaaaaaaaaaaaaaaaaaatagctgtgcatggtggcgtgcacctgtggtcccagctactctggagtctgaggtgggagaatcgcttgaatccaggaggttaaggctacagtgagctgtgtttgtaccaccgcactccagcctgggtgacagagccagcctctgtttccaaaaaaaaaaaaaaaaagaaagaaagaaagaaaggaaaggaaaatgccccctagtggattacgttttaaccactgtgctaacttgagagatagcctgctatctctttacgggacatgagggctgataagcacctcattgcatggtcctggggactgatgaacaaaggctaacatgtggaaaagagcaactaaagaaagaagagccacctccaggttaattagtagaagtctcctcgctgatatgctctcatacactaaaacagcagtaaaaacaacctgcacattggcatcgagggcacagataaacttgccgaggacccttaccacgacagagggatgctttatatgaatccttagtagattaattaagttcttgctatttccagttggaaatgatactgtcctcttagggctattcagagaagttcatcttgatgaagtgagctgtcctagaatggcagttcccgggcagcagagcctgggctcaaggaaggtggaaagagggggtggcgaggagctgccaggtgcaaatgtcaggccagcaatgcagtccagcttgcatggacgtgcatcacctaggaagttgtgacttggctgcattttccacttcaggtgagatggaagggtgaactctacctcacctcctggtgaggttgatgtttcctggtgtttataactttctttgtaaatacttgcaaggaatttaccattttaatgctggaagagacgtctattccttcataagaggacctgagtggatcttgattgcaggccttatgctgggcagagctaaggaaattcaatttgtctccaatcttatttgaatgttctttttttttttttttttttttttgagacagagtcttgctctctcacccaggctggagtgcaatggcacgatctcggctcactgcaacctctgcctgctgggttcaagcaattctcctgcctcagcctccccagtatctgggactacaggagcatgccaccatgcccggctaattttttgtatttttagtagagatggggtttcaccatgctggccaggctggtctcgaactcctgacctcgtgatccacccgtcttggcctcccaaaatgctgggattacgggcattagccaccgcgcccggcctatttgaacgttcttatgcctgctacaagtgcagcagcagaatctccacacatcttgagtgcgaaagtttcctgtagttcctttagcatggagaggctggggaaggttacagactgatttgtactctttagacatatagttgatcattgaacaacacacgtctgaactgttacacacagatttttttcaataaatgtgttagaaaatgttttggagttttgcaacaatttgaaaaaactcaaagacaaaccatgcagctagaaatatcaacaaaaatagaaaaagttaagtatgtcatgaatgcataaaatgtatgtagatacctagtctattttattatttactaccataaaatataacaaaactattgcaaaagttaaaatttagtaaaacttatgtacacactcacagatcgtatatggtgctattctcagttgagagaagtgtatacaaacatcaagatgcagtattaaattgtaactgcataaatttaaccgtagtgcataccacagtacggtaataagttcatagcctcctcctgttgctgttgcaatgagctcaggtgttgcaagtatccacttaaaacgttctgtgatactcaacattccatcatgagcaggtcatccccagtgaattgcgcatcccagtaaaaagtgccctctccctgttcacgtgtatttttcatcctgtttcgcgctgtactgtaaaccttgaataacaccatgggatccacatgaagtggcactagtgatgctggaagtgctcccaacaagcagagaaaagtcatgacatttgacattacaagaaaaacttgatttgcttgatatgtaacagagactgaggtctgtagctggggttgcttccatttcagacagatgattcatcttgtaaacaggcggtgtaaacttactgtatggataaatacataacagtaccatagatgtattttctccttagaaacgtttccttttctctagcttactttattgtaagaatacagtatataatacatataacatacaaaatacatgttattaactgttgctggtcaacagcaggctatcagtagttaagtttgggggaatcagaattatacctggattttctactgtgtacggtcagtgtgccaagcccccaagttgttcaagggtcaactgtaatcctaaaagaatctaatacaatattgtacacagtaagtggtcagtaaataaggaattgaactaaataagaatacataaatctcagaatatgtgcaacctgatcgtagtacacagagatctctctatatctcttttctcagttcatgccattatttcaggtagaaagcaccttattttgaattagttgtctttagagcaaaaatccgtctaagagtgcagtgtggtttcctatgcacaatctggaatagtccattgcttcatgcctaccctggacatgaagggccgtgccacagtggaagtctctatgcatccacccctgtctatacctgagcaactcattcctctttgctgctctcttacaggctacagagtgcggtggcgccagcacagaactctgctcaatgtccctctgtgctttcacgatgctgatggattatgaaggtagggaagaatgtacagccaggaggccattaggagggcaactaatttataaaatcgcatttgtagaatttaatgcatccaacacctaccaggggaaaggtgggcaaaagctataccaacaccacccaagtcaaaaccaaaacaacaggaaaagaaaattatgtggatgtagaatttctgataacatcattcccaagatgccttatccaagaggaactgctacaataatattttaagtggaaataaatacatgctggaagcattatatattagtagactttgtttttttttttccccaaagtactttctcaagcacatcaacataagccccctaagagacatttcacattaaaaataaaacgtctgcccactgctggtttctcaatttgcctccaccttctgtcccctttaatgaactgggccacgaggtgagtcagagaggataaagggagtggtaagaatttgaggagagaagagagtgaggctagaataggaaatcaggaaatgcgattcggtccccctgttcctcacatggggccaccctcttgttgcccagtgtggtttcttcttgagggttctgcatgattcctcaatcccagggaattccacaggatgttccacccaagaccattgggctcccacctctactcttttgccagttaatgaataggcaggaatttcactgcctggaaagaggaacaatgctttctggtccttatttcacatctaaaatagagaggtcaattgatttattgctaaatatctttgaacactaaaatagaagttttacaacatatatactacctggttgctctagacttaagccagggaaaagtacagattcaacatttaaaattgagatagacgctttccacttagtgctaccagtcttgctttatttcatgagaatgagaatataataatatgccatacgttcatttgggggaaagattgatgtcttataatttataattacagaaaacatgtgagttcactgggaataaagaaattttgaagataataagatactttcacttatgtcgtaatttctatgtcatttggtgtaggatgtggagatattaacatttacacctaacttaagtttgtcatccaggacctgaaagggttttgtctatcagctgcacccctgggtagcgacacaaccttggggaaggcctcagccccatccctcgtacagcaggaatgagaacagcactgcctgttgggaagcttgagggaggctatggacgtgcagcgcttggcagagggtctcgtcatggaaggttccagcaaatgtgagatacttttctgatttcattttctccaaaagaaagggaataaaagaagaggggaggaaataagactaattgtgagagataaagtacaaaggtgagggaaggagtaaggagacatgaaggcagcgtggagcagctgaggggggagattgctttcaccacttcccagcatctattgcagattccaccctcaatcattttgtaaggaccctttattcaaggtcatgtttgaaccctgctgagccagtggcgtgggtgtctgagagaatcattaacttaatttgactatctggtctgtggatgcgtttactctcatgtaagtcaacaacatcctgggattgggacacactttctgggcactgctggccagtcccaaaatggaacataaggaagtggttcttctacttcttttatttctgaaatcaggtaagacatagtttttttaaattataataattattttttctcccacaatgcagtacaaatacatatgccatggctttatgtgcaattcatttaatttttgattcatgaaactcccagttgaaaatcttgtataagattgaggaattcttcaagaaataagtttagttttcctgtgaagattgtcagcgtgctggaatgaatgcgcagagaaaataatgggtggtttttcaaatctaaatgagtgcacccacataatggccagtctaattgaaaaagagccaatgtagctaactatgcaaaggacggctaagctcttcgcctggttctcagtttgactaatttatataatctctcttacggtgtcatgctcccctcacttgcaagttaaaacaatgaaatttctctttgaatatattctgttctctcaccagttcatggtggtggcagcgtcagggattcagcatttctccctttgttatggcctgaggaaggctttccatcagtatacgtttgcctctaatccccggaaaaatcacacgcatccatttgccagatgctgtgtgcagacagtgattcaacaaatactcacttagtgcttgggttaggtcgctacatttttacacatacatacatacctgtgtgtgaatgtgagtgtgagtgtgtgtcctttacaaatactagcttatttagctcgcggtataggtagggtagcatattcaccctcattttataaacaaagaaatctagacaggaaaatcatgttatttgctcagtgaccaaattctcaaatctgggaaataaagaaaactggatttaagccaggtttcccagaaggaatctagggctcttctcacttttcagctttgtttaagcctttgaaataatattctaaacatgtcctagtagttctttttctttttctttttttaaaaaaaagctttatggagatataattaatgtatagaattcacccatttaggcatacaatccaatggatttcaatatattgagagttgtgcagccaccatcagaataaattttaaaactattcatacccccaaaaacgcactccactctccttagctgttacccccgatctgcagcttctggcaaccactaatctactttctgtatttatatctttgccattttgaacatttcatacgaacggaatcatacgatttgctagtagttcttcctgtaaataatgtatacttgaaattcaatctataaattaccagataaaattttacaagttgcactttagagtcaaatacatttgaatttagtggaagccattcaaggagctatcaaacaaaatacagagcaggagaaaattaaagaaatttttgtaagaaattggtgtatgttgggggtgtgaatattatatttcaatgcatggaaactatgacatagatcactgtgaacttattcagtgggctacacccaaaggctagaacaaacttctccgccacaggattaccaatgttttaaccaacctggggggaacattctctcataagctcttttggaaagccaggctttctgtggatgtatcatctttccagtgtgctgcaatgcccggggagaggaaaaagtttcttttacagccatgcttagtgggaagtggagaaacatcttccatttcacaaattaagtcttttacacatgcaaatatgcatacacattcacacaccacagtgaggaagaaattctcacaccattaataaaatacatttgcatcagtagcaatatacatctgcattttgcctataatataaatgtatttttccactaaaagatttgatgtttccttgccagcaaataagccctatcaaatcctattgccatatgagtcctagaggtgaataagagaaaaaaaaaatgggggaaaattatttcaaattaaaaagaaaaaagtttgattctgttttgggatatttcctagggacaggagctggggaggggatctcagcagcgatgcgctatgaagtataataacatgacacagagaacttaattgaagggggaaataaatggaagttttctttttttgaatatcaattgtagcctgctctgctatacttcaaaaaaactcttcagaaagtttaactgaactcaccgtaggacacactttgtggatttattgtgtgttttgaagtcacactgcgagctatagaattaaccaaaacacaactcttcttggaaatgagagttcaagttggcagaaagtgcggggtaaagacatggatatgggcctaaagcatctatttctttgtgatcttttgatacatctctcaagtgcttttcagtggattaggtttagaatgcatcagccaactcctgctcaataatccatttttccagcccggaatgtcttaaattgaggaaggacgaagtcccagaggtggggagcagggggactttggccgaggactttgcatgaattgatgagcgtgcatcctcctccctgtgctctgtgtaccctcaggaggtcaggacgggcctttctgagaatgagaatctgttcatttgccttcctactggatatttgtcatcagcatacaaaccagtgcgctctgcagtgtgtcatctttcagaacctcccctgacctcatcttccctggagggctcgctgtcttcagagccaggcttgtctcccgctgccgcctccactgctctcctcgtcactctataacccactccctctgcctgcagcccccaccacgcccctcaaagtggtcaaggttgtcctgttgtctaattccatggagcttggctatcttcattttattagcctcttttggcctcttacccctgtgaaaatcactagcattctgtgcgaaggatggagctggcatctccaggcttggaatagacctaccaaagctcagccagatgtccggaagagcctcaggacaagggaacaccctgtagccttgtggtgggagcacagctgaggcccccttggccaccctctgccacgaccaggcagaaagcagctttcggacagattcgttgtctcagatttgatctcaaagaaaaaccaagaccagtatttgtcccaggttctgcttttttacaatttcctccgaaatccagatacctgtcaacaccttggaaaaactgatttctccccagttagtagtgttgtgtgactgtcatcagcccagtacaaaaatggccttctttgttggggagcttcttaccctccagtgttttgcccaatttttgtccaagttggcaacataatttagttcagttcttgtttatttccaccatcatctatgcaccaaaatttatgtgtctcaaggagggaccattcagaggatgcttcccaccagttcaagtgacagtgtcagaaccaaagcgcatattgtaggaaatcaaacaatggcctccaagttccatttctacccagggatgaacaaatcaacatcaatcttggtaacacaactgccactgatggtgccttactcttctctcatgacatggcacaattgatagcaaacataaaatttgttcttgtttaaggatttatatccactaatatggtaacatagtagtggttccatagttctaacctgtttatcaatccagttaatcttttactatcttgcaatctgttaatgaaactgtttttctttgttttataatttcaacttttagagtcaggggtacatgtgcaggtttgttacatcactaaattgcgtgacactgagctttggggtacaaatgattcccatcacccaggtagtgagctaaatacctactaaataggtagtttttcagcccttgcctcgctccctctctcccttctctggtagtccccagtgtctttagttgccatctttatttatgtccacatgcccaactgtgtgttcttaactaaacattttgattcatagctacccattctacttccagtaaacagcaagttttatttggttaatgctaaccaaatagattaaaaggaagtcatgacaattagacattggcattgatttactgaccatttattccacttggatctcccacctctaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcaggtattttcatcgtcgttgcacctacccagaaatctgtaattcagatggcaagtaatttactcacaaatttattaacgatttaagaggaaagagaaatttatggagccagagtttggaactatatttgctcatagcatgtgaagccatactaacagcttcttgttaaggtttactggagtcttcattagaaaaataccctaaaaggaagttatttgtttttacaccggacataaacattagcagttattgttctgagctccagtttttaacatcatcatcagtaaatgtttgttgaggatcatatgaatgaaagtgtcctagatagatctgagcaatgacttatagctacaagatccagtgcctgcccttcagtatttaaggtgactggatataatgttaaaaaaaaaaaaagacagcctaagtgagctacaggcataatcaatgcatgttctacccagatccagaagaaagaacagtgcctaaggttgaggcagctagagaaggctcagggaggaggtgggaaccgagctgggtttggagttgagagagctcttgaaaagcaccaggaaggcaggggaagatgcggccctgcactttctgagggggaccattaagagatcaagttgactaaagcagagactttgtgtaggtgatgagcctgggaaagtagctatggatgccagactgagcacccatagcaggaccacgggatggagatgggaggggtcaggggccagggtggggtggaatgtggggcagaggttcaggggaactgatcagagttgggaggtcatggagatggactatcttggggaatgggttcaaagcaaccagagttgcttctttctgacccaaaaacaaaaattaagaagatgagtgaagaagaagtaaaacagttgaaacagaaagaaagagaaaattatgagggagggaaggtaagggcagataagatttactgccacgttggtgtattttgttcagtacttcatcaatgccatgcccaaataactgaaagaggcagcaattctgagctctctggtccctcaagatagtcaatgatctttagcatttctcatttattaataaacatttgttttctttaaataaagaaaaatacttattggatttcctgcttcgttctgcagggcattccaatatcacagtaaagagcaacaatgtgtgataatggctgaaaacaggaagtcctccataatcattaggatgagagatgcagttttatttgaaaagtaaagtgagtacattttcttcctcctcctcctactgtcctccccatcctcccactcttcctctttctctattctatctttaatttatgagaccagaggaggaaggcgctatggtgttgtaaaattgaattctgagttaggacaggatttgattactaactaaccatgtcagcttgagtatattacttcacctcctagatttaatttttttttgttcaaaaaatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggacgaagccttgtaaaacagaaatactgaggtgttttaatcctcagaaacatttagattgggacacaaatcttattttttactcttaaatttttcacattttgggggacatggtctatatttttctcagatttctgatatgttgtcttttaaaaatgtgtaaaagttacagttccttttctatagtttattttaaaatgtgggtcaatagtcccactgcttagaataagaggcacacaggatttcaatagaaattgcatgcctttttagatgtgcgaatgtttcattaagcgtatgaatatttgaagagatgtatgacactttaaaaactgtttcctctactgtgttggtggccaggtattaagactgttaataataacaatttagctctccaaatatcctgcatcacaggtgttaaagaggactggaaacaccttagttcttgtattcttgaggatgatttgccatattgtgtctagtatcacggcaaaactccaagtagcattttaaatagtatttatttgggttggaattatttctatgcattgactcatcttcctgggtttcattagctgtacgcattgtactttcttccttaccactatttatctcgaattcttgagattaaagtacagatgaaatctaaactttatctggtaaagttattagttcttacaagtagcaagcaaacggtaaactaaataggatgacctaattgtaccagatttaaaaaaaaaaacaaaaaaccctgattctcctgattctctctacaaaatgctaacatttaaatatgtcatttgtaaattgttaaccagaaggaacatgggaatgactgtaggttgagtttgaagtgtgaagtttgaaggcttagtttgcttgttttcaaagtgacagaagggagcaaaaggttatataaactccggtgggtacatacagttgctgtgggatattgacctgctgctaacttacctgccagggtttttccaggaacagtcagtgttagatcacgtttacttctgccacttgccaccagccacactgccttcaccgagtccaagaccctatcaccactggttggggctacttgtagctgtacacctgatctcgaagaaatataacttccctgtttaaagcccttcctagtgcccttaaaataagacccaaagacttcccaaatgtgccagggcccggcattatttacgtaacccccggctgctgtttgcttggcttgctaaacttttctacaaagtttctggccttacttctgttccttcaccaccccaagcacacgccctcctgcctgggaccctcttcacctttgtcctgctgtgccagctccttcttatcgcctaggtgtcagctcaatcatcacctcctttgcaaatcttccttgacccctagacctccctttcacaaagtaccttgagtttacactttgatgagtgtcttatgtctactgtaatactatgtcccaatgaagatgtactggcaatcataataggtagtattgggttaaaagcattagtttgctgtaggtacgttaggagtactccccatgtgattgatcagtgaatttaaaaatggctaaagtgggtaaccttaaatgatggtgcaaatataccttaaacattttatattttcattgaaaacacaagtgtacttgacacctcttgatgtagagcagaggctttttttcttcgaatatggggtcaccagtagaaggtctctggtgcatttcctgcataaactatgctctagtgcaacatctacaataattactttccttatttttgaagtggaccatatctcgacatttattaatcaatctgcatgtgtaaaacctttagatttttatgaattcctcctcaagctttatagtcaactatatgagtggattgccctctgtggatctgatagcaattttttaaatgattcacgtttcaacttgttaaaaacatttaatttagttaaaaaccaaacaaaaaagagctttgtttcttttcacattcatttctcagtttagatcatctttaattaaatataaatgtaagaaagttggaaaatgcaaagaaacgactcgttgtaagcacataactcacgtggggggaacagacatgggtgggcacactagcaaacacctgccagctgcatgtggacccaggtgggcaccggactgttttaaacacaggagagggcccattgtctaactggtgagttggttgagtggaagctggttgagaacttttactgcaaaccatttacagtagaccacaattttatagtcctgtttggcactttttcatatcactgggagcctgaagaaatagaagtgggttggatctctttcagcctcggaaaagcctgccattcccccatctaaaaaccctttccccattctcttactctgtctcatcatgtatgtaacatgtatccatgtatcatcattaagtgatctcattttatattgtttacttgaatatttcctgtaacccccctgtctgattccactagaatgtgagctctatgatggccaagcctctggctgcactgtgccccgtgtgtccccagcatcctggtggggctcaatacacagagagctcataagtagcatttgaatacatgaatcaaagtatggaatggcccagtttactgcagcctttttgcaggtgcaaaagatgatcttttagaaagcagaaacagggggtctggtgcatgagatctttttctcaatgtgactgtgctgtgcagaccttcacgtggtgtcttgtgaaagactttgaccactgtgtggactttccttcagtgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctccgggttcaagcgattctcctacctcagcctcccaagtagctggaattacatgcatgtgccaccatgcctggctaattttacatttttagtagagacagggtttctccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaactaaaaaaaaaaaatacctactgaaaaaactgtcatcgtttcacatttctggctacgttagtgcaaaagggaataaataaaggtgagatttgtgtgacagtgtggatatggtactgtgtgacaactcagttctcccatcacttccacctgtttgaatcatcgggatcctttatttgtacaccatgttatcggtatttgcccttaagcaccaccaatgcaccacttttatattaagtctgcccgttttccttagtactccataaaatttaagtcacatattactctgcctcaccatgttacttcaataattctgaatcaaagtttaagtttgtgaataattttgcaaaaaaagagccaatcatgcttctcaacaacataaaaagagaagcgccgtcacttcaggtgaatattgttctccgtgaggccatgagcataaacaaaaactccagactaaaaccctgagacggtgccaggtcattcagcagtcagcggaatgatcagtataatttcaaacaaagttttaaagatcattattgaaatgatgtattttgagcttcctggatctgttcctttatgtctaccttagttcatttgggctgctgtgacaaaaatatcataaactggagagtttataaacaacagaaatttatttctcaccgttctaggggctgtgatgtccaagaccaaggcactagcagtgtctggtgaggccctgcttcctcatagatgacacattctggctttgtcctcacatggtgtcaggggctagctaattccctggggcttctttcataagtgcactaatctctgtcctgagggtagagccctcgtaacctgattgactcccaaaagccccacctcagtactatcacattgaggattaagtttcaatataacttttgaggagacacaaacattcagaccatagctttatctatcatgaatttgggggaattttcagtcactgttgcttcaaatgtttcttctgtttctttctcttttttttttttttttttgagacagagtcttgctctgttgcccaggctggagtgcagtggcacgatctcagctcactgcaagctcctcctcccaggttcatgccattctcctgcctcagtctcccgagtagctgggactacaggcgcctgccaccacgccccgctaattttttgtatttttagtagagacagggtttcaccgtgttagccaggatggtctcgatctcctgaccttgcgatctgcccgcctcggcctcccaaattgctggcattataggcgtaagccaccatgcctggctttctctttttcttctctttctggtatttccaaaaagtctccatgttccaccttttgtaattgtctcacagttcttgactcttgttctgttttttctttttcattcttttctctcattgtgtgtcagcttttgaagtatctattgacatctctttgagctcactgattctttcattggccatatccattcttttgatgaacccatcaaaggcattcttcatttctgttatggtgttttttatttctagtatttcatctttatttcttcttagtgtttttatctctttgcttacattacccatctgttcttgcatgttatgccatttttacattagagcccctagcatgttaatcttagttattttaaattcctggttggatacttccgatatttctttcatatctgagtctggttctgatgcttgctctgtctcttcaaactgtggggtttcttgtcttttagtatgctttgtaattttttgtttgaggctgtatatgatgtactgggtgaaacgaactgagttaaataaggctttagtatgagattttgtgtttctctggctaggagttaggctttgtttactctttgctatatagtcatggatgtcagaggctaaaatttcctctagtgtccttgtgttgtctcccctgtcttctctggggagctccctagaggcttctttgtaaagtagctctgagtcttgcagtgtctatccctaatcatgggaaaacatcaaacaaacccatacagcgggacatctgacaaagtaccaagtgtcaaggatcatggattgaatcctgaaacagaggaaggacactgaaggaaagactgggaaaacctgactgaggtctggagtttagttagtgatactataccaagacgaatttcttagttttgataatttgttaacagttatgttaacattgggggtagctatgcaaggggtgtgagaatgctgttatatctttaaccttggcccatggttaaggtgtttccagtgtaaggtcactgttattccttgtagttaacatatatttggcaccacaggattcattctggaattctccttggcttatttataactttttttctagtagtgagaaacctggctttcatgcagagtttacaaacgccaatttaaacttttgttttgtcatacgcaatgattttattacctgtctttatttcagagcttatgaatttttaattattctaagggctaacatagaacttttccatgttttctactcttcaagagtaggtaagactttagtttgtaatacattacaaaaggaatcctgtggttctctaagagctaatttgtcttggcaaaaggccttagcaagctgtgagtggtggctcatgcctgtaatcccagcactttgatctgagacggctggatcacctgaggccagaagtttgagaccagttttgccaacatggcgaaaccccatctctgctaaaaatacaaaaaattagccaggcataatgccatgcacctgtagtcccagctacttgggaggctgaggcaggagaatcgcttgaacctcggaagtggaggttgcagtgagccgagattgtgccactgcactccagcctgggaaacagcgagactgtctcaaaacaaacaaaaaaaccaaaaaacaaaaaaattagacgggcgtggtggcatgcacctacagtcccagctactcaggaggctgaggcaggagaatcgcttgaacccaggagttggaggttgcactgagcagagatcatgccgctgcactctagcctgggtgacacagtgagtatccatctcaaaacaacaacaacaacaacaacaacaaaaacaaattaaaaaacccaacaacaacaaaaccagcaaacaaaaaaactaaacaggctttagggaaagagcaatctaattatctgattatatgattggcactaagatgggaatgactctggcctgatttcttcagtttacattttaaaataggagcttagttagcccccaaataatatgtaattgatgtattagcgttggggagtgaatatttttcaaagcagaagatatttctcaattcttgcttacttttagaggttgaagttcaaggaagccccttccttggcactgtatcccagggaggtatttggagttaatttcagggcttagcagtgactctttagaaaagcagtatacgattgaaatgtaatgtgttacaaatgagatcactacaagtaatttaaaaatgtgctagtagtgtttttttttctgagacggagtctcgctctgaagcccaggctggagtgcagtggcacgatctcagctcactgcaagctccgcctcccgggttcgcgccattctcctgcctcagcctccctagtagctgggactacaggcgcctgccaacacgtctggctaattttttgtatttttagtagagacggggtttcaccgtgttagccaggatggtctcggtctcctgacctcgtgatcctcccacctcagcctcccaaagtgctgggattacaggagtgagccaccacacccagcctctagtagtacttttatcaaaagtaaatagaaacatgaaattaattttcacaatacattttatttaaactaatatgttcacaatgttaaaatttcaacatgtaatcactataaaaactactagtgagatatttcacattacttttttcatgtaagcctttgaaatctggtgtgtattttatatttactgtacatcctgatttggaataaccacatttcaatctttcaatagccacatgtggctagtggctactgtgttagagcagttctagaacaaaggagtccctttaaaactattttgaagtcatcgtctataaggcaatatgaaagctgatctgaatgatttctccttttccaggaaaggaaacaaaaatgaaatcatgttagggctgcatattttatggatcccaggagaaatacacagtctgaaagaatgatctcagtcagaaactcagaatgaatcatatgaattaaacattggacaatgtccaatgctcagcatgtgtttttggtttatactaagagcatattatgccaccaaatacagatatttactattatacttcgtgtaggaggtatattgagacattgttctagactaccacagttccatattttgtgaaaagttatattgcactttttttttttttgagagtgtgcccaggctggagtgcaatggcatgatctcagctcactccagcctccacccccccaggttcaagggattctcctgcctcagcctccctagtagctgggattacaggtgggcaccaccacatctggctaattgttgtatttttagtagagatggggtttcgtcatgttggccaggctggtctcgaactcctgatctcaggtgatgcacctgcctcagcctcccaaagtgttaggattacaggcgtgatccaccatgcccagccttatatttcactctttgggaattgcatcttactgtaatcttaaactacactaaaataaataatgtaaaccttttgtcaaattgctcagagtaggtttctactttggttataaggaataaaattcatgcttttgtgtacacactagacatctaaagcaaccaaccatagttaacaagcagtgctcttaccaaaaggtaactctttctagaatctggcacaccatttaatatcagtatgagcatatggtgggtttaataattgttttccatgtttataagttttctttagttttataagcagttaaaatgaatccctttcactgaaatacaatctgtggtgggacttctagcttttctcgatcttacgctgctagatttatgtcactgccatagctatgcaatgggtgatatttacactatgctcaaacaaagcaaccagaaaaacacatcattgaataatacagatattctgaagtcaagcaagccaactttcattaacagatcaatttccttagaaaagttgatgaaactaaagactgaagttcaaagaaaaagccctctcaagggggtatgaatttctggtaacttatggggtaagaaaaagagcaagaaacttgaaagtagggaagagaaaaaagaaaaggagcaagagggaatagccagctctcaaaagagtctccaataggaaagcaaaatctgtatctagccagtaccaacatgtgaagaaagagtgagcatagcaaaattgagaaaggttgcttgaaaaccaaacaaaaaaccaaatacctgtaatcctagcactttgggagggtgaggtgggtggattgcctgcactcaggagttcaagaccagctgggcaacatggtgaaaccttgtctctactaaaatccaaaaaaaaaaaaaaaaattagccaggcatgggctgggctgggctgttttccaggctggtctcaaattcctgggcttaagtgatcctcccacttcagcctcacagtgttgggattacagtcacgagccactgtacccaaccatatgtcattctttagacacactgcttactaaatttctctttttaaaggatatactgaatttccggttgagccaacttaacagctaattttctattttagctttaaaacattgataagcaacatgaagcaatctagaacttaacctttaagtggctttattaaagcaatccagctatgaaaattatgcagaaatgattatctacaatcttaccagcacataagaaattcttcctctattctgaaataccatcttctcacaatatactttgatgttatgaatcaatgtctgttcttgaacattatttattgtctttctctattaaacaattccaaaataaaatttccagcacaactaaatattgttgatgataagaggatttttaaaaaagttcttttaaaacagaagcttatatacaacttagaatctaaaaccaatagatttatggtaaaccttaaaactgaaccaaaacaaacaaaaaccaaagttttaatcatttaaaaatcatgtttattgaggtacaacttatagtaaaacctgcccttttcagcgtatagcactgagtcttgacaaatgcacagttatgtaccaccaccgaccaaggcctggcacatttttacctcctcaaagttctccctggctgcttctcccactccttggcaaccactaacctgttttctgtccttatagtactgcttttttcagtgtcatataagtagaatcacactgtacatagtattttgagtctgacctctgtcaactggcataatgcatttgagaattatccatgttgctgtactggcagtgcattcttttttattgctgagcagtattcaattgcatggctgtaccagtttgtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattacccttccagacacctttctgtgttttcatacgtatatatgtatgacggtttgaccttaggcagagtagcattttcaaaattttacatggggaaactttctagatttaaagccattttatttttctgttctgtctggttttatctacgtgttatttacaatctgctgtgtaacaaattactacaaacttagtaccttaacacatatttatttcacagtttctgtgggtcaggagatcagaaatggttctatttcaaggtctctcacagggctgcaatcaagatgttggcatggctggggtctcatctgaaggctggactggagaagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtatgctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctcagatctggcaggctattgtgaggcaatgtgtcattttaccttataacgcagagttgtaacatgctactctgagcagctcatgacatctgcttgaaatttaagttgggcccctagtatgtgtttattataaagattttgatgctgcttttcagagttgggtaacctactttacccccttagctaatgtttcccaaatacacccaaacccacagaaaggaaaactattcctcattaactcacagccaacatcataaacattttatatctagagctgatgatacagtcaggtatttaccaacactcatgtatatatgtagagtttcaagaaataattgcttatccttactagattcaacatattctaatgtttcacatattatttttatttcttaattttttttttaaagatggggttttactctgttgcccaggctgaaatgcagtggcatgaccaggatttcgaccagaagtttgactgcagcctcaaactccttataacaaagaatcctgctgccttagcctcccgagtagctaggactatgggcacatgccaccagatctggtatattttaaaatttttgtagacatagggtctcgccatgttgcccacgctgattctgaactcctgttctcaagcaatcctcctgcctggtcttcccaaacttttgggcttacagctgtgagtcactgaccccagcttgtattcttttgattttaaaaaaatattctgaatgtgatccaccaaattaatttcaccatccactaataggtagcaacctgaatgaaaaatactgttataaactttacacaaaaccagagattataaacatttgcttccaaggagagaggtaaaaggtacttgtttgctctgatgggccctgtttccttcagtgccaggaagagtggctctcagacctttcttctggcatccctcatgtatgcagtgttggttattattttcaaggccttggtaaccaaatgcccctagtgtgaccagtcagactgacagtccatatctgtaatatggtggtaagtttcctttgcatgtctttctttctggcatcttagaacttttacctaggaaattttctttttgcttgaagtacatcattaagaattttcagtgaaggcagattcttaaagtttttgttttccagaagagatcttggaaaatataaaaggttggcagttatttcttttagtacatgagatagtattacaccaatgctgttgagaagtctattgtgaggcaatgtgtcttctttctctggctgcttttgagatttctctctgtcttttttaggggcagttttactcttatgtgactagaagtagatttcttcttttttttttaatattgcttgagattttattgggtttttgaatctgtggatagatatccttcaacagttctgaaagatttccagccattctcttcatatattatctgtgctgtattcttgtctctccttttagaacttcgattagtaaaaacatgtttgatgtcttttcccactcttgttttttgtttctcccatgctgaattctgtgtaatttcttttgaactatcttgtagtttacatttttttttttttttttttttttttgagataagagttttgctcttgttgctcgggctggagtgcaatggcaccatcttggctcactgcaacctctgcctcctgggttcaagcagttctcctacctcagcctcccaagtagctgggattacaggcatgcaccaccacgcccagctaatttttgtattctgagtagagacggggtttcaccatgttggccaggctggtctcgaactcctgacctcaggtgatctaccctcctcagcctcccaaagtgctggattacaggtgtgagccaccgtgccaggccttacattctctctcttaaagagaaaatgtaaggtatctaaatctgctgctaaaccatcattgtttttaattgtaataaggtctcttttatgtactcacattgataagagacaagtaggaaataatctttaaagggcaaactaatttaaatgtgttttcctgtctgtttacaggacttaccaaatgcacatcttagagttctgggtttctaatgtgtatctcctctatgaaattctttaaaaatatctgttcttggtatcccttaggttagtctcttttagaacttctaaatcaatggacccttaacttataggagccacctggacgttagcaacgtctacattaaacatgctgagcttttaaaagagacctgttagacatgctgagtattttgagataatatcattgttgtattgaaaactattgaaaactttaattttaaaatgcaaacattcttaaagtcctggttaattttataactataaaattagttataattttgagatttctgtcttgttttttataggggcagttttactcttaggtgactagaagtagatttcttcttttttataactataaaattaggtttacttttgttagaataaattaaagacagtgaacttgtaatttgaataactactaaaaatatacatgatgtattcttatttgggcccttgtgacaaaaatactattgtggctatagaaacctatcctatagtttgaagaactgagattactgtcagtattgagaacattcctccttcatcattagaaagattattaaaaaccagattcaaagaaactatcaatactacttatgaagtatgtctgtaaaaaaaattaagcctgaatcttatcaggcctctagaccagggattctcaaggtatgggccccagaccagaagtatcagcaacgaattgctaaaaatgcagaatcttgggtcagaaattggggaccagcaattggaattttagtaagtataccagatgattcagatgcctgctcaattttgaggatgactcttatcagtttagttattaggatttacaggggatggggaacatgttaaagagcaccaactagataaggtcaatcagtcaaaagtaagatgtctggacattctgggcctcctgatgtcttagaaagcacacaataccatctatggtgtatttttgtccaccatcccacccaattgcacctggatcttcctatttataggcaattagaacaagctcagtgttaccctgtaatgattaaaaaccaaatataggactgctatagcataaatgaccactttcttcaattaataagtggcacattaaaaatatatttatatatgtaattgttatagataaaaaaaacaaaatggccgggcgtggtggctcacacctgtaatcccagcactttgggaggccaaggcgggcagatgacaaggtcaggagattgagaccatcctggccaacatggtgaaacctcgtctctactaaaaatagaaaaattagctggcgtgcatctgtagtcccagctacttgggaggctgacgcaggagaatcgcttgaatccgggaggcggaggttgcagtgagccatgatcggaccactgcactccagccagggtgacagagcaacactacgtctcaaacaaacaaaaacacaacaacaaaataaagcttaaggaacatcaaccaaatgcaatatatgagccctatttaggatactataaaaagacattcacaataacacaggcaaaatgaacataaactaggtataggtgacagagaaatccaataaacattgaattattcactggggaaagaaatgatgtgtgggatttaagtctctaactctcccctatttacgccaaaagattgtccatgagttgaaaaccgttagagatgggtgacaactcaagagagattatagcgtcttccttgtgcttgtaaatgtcaaaaataaaagtaatttaaaactaaaacaaaaatgaaaccataattcttaagatgcagcttgaattcagttaactatagcagttgtatatgaagcatttcaaagaagttaatgacatcacagtattaaatccatctgacatggaaaccaactctaactacatcatagttttttttttttttttttttttttttttttttgagatgggagtctcgctctgccgtcaggctggagtacagtggcgtgacagatcactgcaacctccacctcgtgagttcaagcgactctcctgcctcagcctcctgagtagctgggactacaggcacatgccaccacgtccagctaatttttgtatttttagtagagacgagatttcaccatgttggccaggatagtctcagtatcttgatcttgtgatccgcctgcctcggcctcccaaagtggtgggattataggcatgaaccaccagtgcctggcctatggcacagttttaaaactgcatttgcctagaaagtggactgctgtatatagaccaagtgttgggctatatgactccattgtcttaggctatttggggttggaggaaggaagaggggtgaagtagaaaaggaacaagctaataaatgttttttaaaaagtagaatttaaaacaaaaccacgttcagctgaacaccagaactcaacaccaggataaaaatccaattttcaaagagctagaagatcaagctaagcacttattgtattttgctgaacgttaaaattatataaatgtactacagttgcctcaagatgttaaaaagtcagcttttcaaatctagtcacggcctactcatatgacagacccaatacaaatgagcaaaattgaaaagttacacatacagacaacttctcaaccaccaggctgtttagtttaagttagaagtcagaagttctgagactctccttttacccaccttgagcaaccgcagcaagttttcccttttcttcagggctgagctgcaacatcgtatttataacaggaagaaggctctctctctcactacctggcttcaagaaaatgaactgcagcaagacgttcttcaagtgttccacgttagctgcagactcctcttgattcctttccaatcttcttatttcacttttgagaagctggtgttagagaaatgagttaaaaatgggctttaggagcttctgattaaatatggcagactgaactcatgtatttttcttctcttccccccaaatttcccccttccctccatatggcaataaaggaaggaattcagttaactacagcagctgcatgtgaagcatttcaaaggagtttatgacatcaccgtataaaatccatttgacatgaaaaccggaactccaactatgagatagtttcaaagctgcatttgcctagaaagtggattgctgcatatgaaccaagtgttgggctatatgactccattgtcctaagctatttggggttggaaggaagaggggtgaagtagaaaagcaacaagctaatacaagaggagaaaaagtagatgagataacgtcaagacattctcacgagaaacagatgaagaggtggaaatgagtcagtccagcagcttaccaagtatcactgacaggagaggatgcatcctgtgtaaatactggagttcttgtctcagaagcacagggtatcatggaaatggagttgaaagctggggaactgatggaacgtctccatgaggagcaactaactggagccatgggttggtaccaagatgttccctctgccttctacttttgatagaaactaagccagtatggcatggggctctgaaaatgggctgaggggaacatcggtagcctccactaaccccctgcccctacgctgttcctgaagtcccaggcagttaagacgtccacagtgaacggcacttaaaaagttcagacacagtgaaaattcaggaatataagacaatgtaaaacactatcagagaaatgaggcaaagaacgatataaaaaaggtagtatcatgttcaagtctttgaggaagatttccaggttgaaaccaagccatagcttttagtatattttcattttaggttaggcaagaaagttagcgaactttgtcctcaaacctaggaccatttaaaaaagtgacaataaagaagacgaagaaatcatgaagagagtataaatttatgaaaatataacatttggccaggcgtggtggctcatgcctgtaatcccaacactttgggaggctgaggcaggcagatcatgaggtcaggagattcagaccgtcctggccaacatggtgaaaccgtgtctctagtaaaataaaaaaaattagccgggcatggtggtgcgtgcctgcagtcccagctactcgggaggctgaggcaggggaatcgcttgaacctgggaggcggagattgcagtgagctgagattgcaccactgcactccaaacctggtgacagagcaagactatctcaaaaaaaaaaaaaaaagaaaatataacatttaaataagtcatttaggtttactgggctagttagtgatttgttagctatgataatgtttttattagtgggaaaatgctattttatagagatgcatactgaagtatttaatggtggaatgtcatgatatatacaatttactgaaaataactgaattcggctttaaaataatctgacaaggatagctagtggccttgcacagtggcaggacagatctactaggaacagcaaagtacaggggaaaagcatgtacttttcagacagctatgagtttgaattttgttccaccatttaccagcttcaatttttctctcaaccagtgatgagattaaataatgtatgtagagcccagggcctgggtcataagaactcctcaataagcagtatgactatattctgaggggtgatttatcagtgagccagggtggaaatacctcatttgagtaatcctcaactgttctgcaacattcctagatgtttctggtgtctactttaaacaggaaaaacttcccatgccactttgccatctccacctgaaaactgtttagtagttcagtactataaatatcagttgaataatttaaattcactggttatctttagaattcaaagactcacacccattttttatttaagcatatgtgaacaatgatttgtgaacatctctctagtttctaaatctattacggtttcttaggaaaagtaggaattaagaaataatctttatgtaataggtgtaaaagaagtattttggctggatgcggtggctcttgcctgtaatacccacactttgggaggccaaggcaggtggatcacgaggtcaggagatcgagaccatcctggctaacatggtaaaccctgtctctactaaaaatacaaagaaattagccaggcatgttggcgggcacctgtagtcccagctactcgggaggctgaggcaggagaatggcgtgaacctgggaggtggagcttgcagtgagccgagatcgtgccactgcactccagcctgggtgacagagcaagactgtctcaaaaaaaaaaaaaaaaaaaaaaaaaaaaggcaatatttatttctcaccatcaggaatctaataatctaatataaagatcaagacgttatagatgcatctgcaatgtgaatttttaaacttgggtgcatgtgtatggagggtccagaaaaccaaactggcggttttcacagtggccaggtttctgatctcaccttaatttgctccataaggactgcactggttgcctctgtttcccgaagcaggccgtttaactgatctgcactttttgtggtggaactgagcttctgaaccaattcttctttggtaaattcagcatgccataatggaggctctgcaacatgttgttccaagaattaattttcaaaatcatacattacagatgaagattctaaataagaaaaatctaaatataaatatcttactatgtgatattttataggtctgctttctttgccattcatctattcaacatacctcaatcaacagattatatgttgtaggtgacacaaataaaacagtatctctgttgtaaagcatgtaatctaactgaatacaagccctatgagtcccagttctgaaatttgtcagaattgtgtttatagacagttttattacacatcttcttcccatctattaatattccaagattttatgtcatttcacgtataaggaaagcattaacatttactggtcacgtatcatgttccctcataagaatcttctatcaggcggggtaggtatcattattcaaactttacagacgatgaaacaggctcacagttgacaggtaattttttcagaaatcacaaagtcaaattggcttctggagtctgctgctctatcatgatgcctccgtgtcaccactattaactttgcctgaaggaaccatgacttgcagtttctaccccatgtggtcagtgaccatgaatacaaatgacccttactccaggtgattctgaagtttcaggaagatgacagattccccctaaattttgaacagtaatattaattacaggtaataaaatataccaaaacatcactacaaaaatttagcattacttcatcaagaggaataaactgaaactgtcagtttcttggaagggtgagaggatagtttatcctgctttctaatacccaccacctatttgtgactataaacttcccaccacttatttatggttcaagcctagggcaagagctagcattttattttaaaaaagatttgtttaataatttttccatttggacagtgtgatggttaatactgggtgtcaacttgattggattaaaggatgcaaagtattaatcctgagtgttgtctgtgagggtgttgccaaaggagattaacatttgagtcagtgggctggggaaggcagacccacccttaacctggtaggtgccatctaatcagctgccagcgaatataaagcaggcagaaaaacctgaaaaggcgagactggcctagcctcccaacctacatctttctcctgtgctggatgcttcctgcccttgaacatcagactcctagttcttcagttttggaacttggactggctctcgttgctcctcagtctgcagatggcctagtgatcgtgtaaggtaatacttaataagcatccatccatccatctcatccatccatccaaccatccaattagctctgtccctctagagaaccctaatacaaacaggtagtggaatattgaaagaaattttattggagcagcccaaaaaagcatatgtaccttagagtaatagtaattaaataagacagtgaaattaaagaagaagaacatatttagacagagtaacagaccaagtttagtttcgggagaattaagcagctgctctaaagactgtgtgtatgtgctggcggaagacacagactccgtaatcagttgtctccatgccttctccctcttcccgggttacagtgtgcatgtctagaagcgggaggtctgtgtttctcctttctcgaaggttcttcaaagactgctgagaggaaactgggcctattagattttttttaaaggttaagtgtgagattgttcaaaatctattgattcggccttacagagatacacaataaaatgaaaatatcaaatgataagagtagaggaattaagtaactataagtgaaaggtgtatgaagaattgctaaaacatttcctaaaatttagtcatcaaggccaggcgtggtggctcaaatctgtaatcctagcagtttgggaggctaaggtgggtggatcacgaggtcagcaagttcaagaccagcctggccaagatggtgaaaccctatctctactaaaaatacaaaaattagccaggcacggtggcaggtgcctgtaatcccagctgctggggaggctgaggcagagaattgctggaagccaggaggcggaggttgcagtgagccaagatcatgccactgcactccagcctggcgacagagcgagactccagctcaaaaaaacaaacaaacaaacaaaaaaaaacttagtcatcaaacttttaactacgttagtcattttaatagcagctataaattaattgctactagctaagataaactgttagataacacagctcataatatagtactacttattttttattaatttagagtagagggccaaactactgctaaatactggccaaaattaaaagactagattctagcaatttttcaggattaggtatttcagattgcggcatacttcttgaaacacacttgccgaaatctgcttggtagacatcctcaatcactgcccttatacctttacctctgcagcttcttaattgttgctgctcacacctacagtgctcatacagttaagagcccagaatccagggcacagaactaatcaattacgttgcctagcaagactttcctgtttgctgataaactatattttttctgagacagggtctcactctgtcacacaggttggagtgcagtggcacgatcttggctcacagcaacctctgcctcccaggctcaagccatcctcccacctcagccccacaagtagctgggacttccaggtgcatgccatcccgcccagataatttttgtacttttaatagagatgggatttcaccatgttgttcagactggtctcaaactcctggcctcatgtgatccacccgccttggcctcccaaagtgctgagattgcaggggtgagacaccacgcctggtctaaactgtaaagtttatcgggccctttgacatgtattggtttattgactcccaaaaatctgaagttcagagaaatttaatgactttgcccaaggtctcataactgagttagaaaccagaattgtaatctagatttttaaacttcagatttcatttattttgcatttcattaaattgccttagtcctgactgccctttctaaagcattttcctgggtttctggtaagctgactgcttattccactgctgattgctagattacaatctcttgtgcgacctttgccctggctgattacttcctttgttgattctttggcatatgttaaattcttctgaagttgcttttttaccctaataagtgaccgatagctgctaatgctccagtgacaatatttcccatgggaaaccaaaacaccatcaacttgctactaaaatactgcatcatcatggctgacatttttccatttcttcctggaagcagaatggaagatactgggtacggctgaactaaaactccaactaattgtaaatatgaaagcaaagaagctatattggttatgcaattctacacattcagtgctgcttgagtgtttctaagttccttgctctagctaatgtttctatttaaaaagtagacaaatttgatgactaacaacggagaacacgaaacaaatctggtgaataccagaattaagacatgtgtcagccaggcgcagtggctcatgcctgtaatcccagcactttgggaggccgaggcgggtggatcacgaggtcaggagaccgagactatctgagggagaatcttcaggttttttcttctcttttgctgtaacaccagtcaaaaaaattgacaaagataaggtattaagtattgacgttaatactctacctgaaaataaaaaccatggaacctatctataggttaaaacagcatactgataaaaaacacatatactttgatgcagagatgtacgataatcatgaattagaattagcatcctgatttagttttctaccaaaaaccctaagtgaacacagaatctatttaaaacgaaagaaaacaaaaaaatcttgtgtttacttaatagtcattgaaaagaattactacaaatttctagaatttaaaaaggttaaaaattttaaagtgttgcctaactatacttagcatacaatagtttaccaaaatatccatgcatttgcagcaattgaaaaaaatcttaaaacataagcaagtattagtatacatatgaaactaatccaaagccaactgtgattagttcctgtaaggaaagttaacaattgccaagaatggaaggtgactagagttgcatctagtttgcctgtgttcaagcatgatactagataaaattaaataaaaactgttactctatgggtagctaacactataaaatctaagaccattcatatggctgaaaacaacccatccccagccaccatcaatgcaaagggcaaaaaattagaaacagaaaaaacttctatatgcaacctgttctgatctattaatgtaaagaacaacttctggctaaaggagtttaataaagtaagccagttatgaagcatgccatgtataccaactggtgacagggaaacattctgagagctatggtgtccaatatggtagcctagccacattctattaaaacctcacaaggtggctagtccaaatcaagacatgctaacagtaagtgtaaacacacacactggattttgaagacttggtgaaaaacaataatgtaaaatatcattaatttttatattaattagaagttaaaatgatattttggacataatgagttaaatcaaatctatcgataaagttactttcatctgtttccctttttaactgtttctttttattctttttaatatggctactagaaaatttatttatttatgtatttatttgagatgcggtcttgctttgtcacccagagctggagtgcagtgatgtgatcatagttcactgaagcctggaacttgtgggctcaagtgatccctctgcctcagcctcccaagtaactgggattataggcacaagccattgcaccaaatgacaattttaaattacatacacaggttatattttatttctattggatgacactgctctgcagaaccagtgcccttccttttacaatgttaaatttgtccctctccttcattataaacgaaaacctagtatcatttcctagctaggagaaataacagtacaccgtaagatacagattcttgttccacttctgctattactcagtaaagacctcttgggtaaatcagatagcctctcttggcctcagtttactcatgtctaaagtcttcatttctaaggtcccttgggacaatgacattatcagattcaaaacagaataaggctctatgttctacagtagtgtataggcacattcgttcttaggtcagggattcctaacctagagctcacagaaactgtacgcaagtatacatccacttttaagttaacacttttcacatttctcaaagaccgtatctttaaaataaaagattaagagctaccttagctggtaataaaactggtatacttaaaaaaaaatcagagattgttattttatcattgtacttgtttggcatggctaagatgtgttactggtcactaagggtgaggtttcacttccctaacctgttcttgaaggccttcaacagatcccacttcttgttccactctagtagccacacttctaaaaatgatctgtgcaacatatataatatgcaagctgtagaatgctggctgttaaaaatggggtccattttcaaatacaacatttttctaaaccatgcacaaaagaacagccctacagggacactcttccatactgtatacatgccgttgccactacatgtgaatactggcagacgttagtggctaaagataaacattagataaaacataggtcttcactgagcagacctgaaatagcagagcaatgaagtacattacaaatcagcatcccagtacattttaaaaaacaaaccaacaagggtgtcatgccaccagtcaaaaggtactttgcttaaactggcattctttaacattcatgttgtagtggtaagtacttcatttcatacagccacagttattaatactttcctaagggctaccagctgctaaaaactgctgttatctcatactgagaatgctagttctatacctttgctctcaggctgtgaggaaggggtgctagtccaaaaggccatgggattagatttaaaaaggctaaaattaaatcctagaaaataaagaatatttcattttttaacattttaggaaacaaaatgaatatgcttttaaaacataaaaagccagaatccctcaatttataccaccaatctgactgtcttacatattcatttatccctgtagtttcattctttgctcatttaatacatgagcaagactgacatacaacacataaaatgagaacatctcaatatcatggttttttttgtttttttgtttttttttttttttttggagacaaagtctcactcagtcaggctggagtgcagtggcatgatttcagctcactgctacctccatctcctgtgctcaagcgatccacctgcctcaacctcctgagtagctgctaattataggcacgcaccaccacgcccggctcatttttgtattttcagtagaaacagggtttcaccacattggccaggctggtctcgaactcctgagctcaagtgatctgcccacctcaacctcccaaagtgctggcattctaggagtgagccaccgtgcccagcctcaatatcatgttttctgagtgacaaaagaaacagaacaaatgaaaatgaacactttaaaaaaagactcacgttaatgcgcatgattcaagcatgagtccgtacactgtaccaagttcttttgctctgccctagcatgatagaagtatcttccagttactgaaatgtctttaactaagttctcttgctctttgaaacctcaccgtgaacttattaagggagaaaaaaaattgctcaaatattttgggggtgttcacaaagcatcgtttatatcccaacattagtatcccacaaagagtctgcatcaagctaaacattaaaagaaagaaaaattgtgcttaactttaacaacaaagtacctacccttttctggtgttttaaatgtgtagttgattgaagattcttccattggaaaggaagcagagagatttttgactttgctatctgaagactgttcgatatcagagttctttgacagttcacattttttaggttccactttgctttcagatccactctgggctactgaactagtttcactatcgttacttttcaaaggtgcattaaaactaaatccaaacaaagacccagtggcagaactgttgccaaatgcaaatgggtttgatttttcactactaaaaattcttttaacagactctgaaccaaatacaaactttggaggagaaaccactgcttttgttgttgtttcagatgtgctagacacttcaacttctgaagctgcatctgctacatcatcaccctgaataacatctgtcctctctcttgtggtttcttctaatacagctacagcaattttgccacatggtgactctctgggagtgcttgaccgagaaacatgaggtgttatcaaagaatctttttcctgggctgtttttgcttcatcaaaaattttcttaaatgagtctgcaacatcctgtagtttaaaacgaacagctaaatgctctacttttctttctccatctgcaaaatcacatgcagtccacacccatactctttctgtccctttcatattttgcaaactcatgtctggagttattctgtgattggcacaaagttttaatacttggtcccttctcatcactatacgaacttgcttattatcataattctgtaaaatctttatatcaccaatgcccctttctttccattgaccaacatctttatcatatctgtagagttctgccatgtgactaaaaacaacttgttcattttcctcaccactggatacttcaactagatcaggtaaaggaacaacaggttcaaagtactgtccatctctctcttcttcttgagtaacatcagattcttcatcagtgccaactgaagtcccactctgattcaacttggcaggagacttagatagactcaaagcagatttaaaactgaagttaaatcctgttgttgactcatcaaagcggaaaatattttttctcacagggctacttgccaacggagaatcatgtactgagctactactaacattatcatccaaagcatcttcccttaaatcatagttatcccattctaatgtgggcccagtgttttcaggattgggttttattgttgtgtctgaggcaccggctgcacctgtacctgaacccttattttcttcctcagtgacttttgtttgatcatttgtcaaaaacgttttgaaatctttcagtccactcttcatttcttcagctctctgtattagcttggcagctctgccagtatctacaagtttatggggagtttgaagtggtatgtctaacagaagccgctggcattcctcaaatttctgcttgaattcttcagccagctctggtgttttaaattgtgctgccaaccgctctagtttggcatcaccatcagagaaatcactggctaaccacatccatgctctatctgatccagagaggggcttcaggttcattgtagttgttatccaatgattagcacacacttttagtacttggtctcttcgcatcagcattcttggtttgccattgacctcatttttgagaatttttaagttccccaagcccctttctttccactgacttatctcagcatcaaatctaaatagttttaccccctgtgaatacagaactttttcaccttcttctcctgttacaagttctactttttcaggcatttgaactactggttcaaaatggatgtcatcgctgtcctcagtcttacaggcatcatcatctttctcaaagtcaccggaagtgtttgctttattggccattttaccgcattgtgatgagaataatttttctccagcacctgaaaatcccttgaaattggggtcttttttgccaaactgaaatccttctcctgaagttgattttgcaacatctgcaaatgtaaaagtgctacttgtttggccaaaaatcacaccacggccattcttctggccactaatatcctgagcctggaagccagtatcattttcaagaggcttttcacttttcttttcttgatttcctggttccgaaatgccaaatttaaatccatcagcagacacagcgatggaaaatccttctttggttgacttaaattctgtattagaagaaccctgaaacataaatgaaggtgaattttcttgatccacatgcccaaaatagtcatgaaataaataccttcttcattcctaaacaatttatcaaatgatgttaacaataatgatgatgatgatgatgataacatttattgagcatttattaatgtgccagctgggcactgttctaagcactttacattattatctcattttaatatcctcaaaaaccctatgaattaaggtattattattaccctcatttcacatatgaggcaactgatgcattgagaggttaagaaacttgcctgtggtcaaaataagcagaagaacaagggtctaaatgcaccccaacactctgtcctcaaagctgtcacattcaactaccactgtaatattgagtcttcaatcaattgttatatatatagctgtatcaggcctgaaagtacttaccacatagtgggtcagcaagggcattacagttctatttctgttaaaacagaacgatgaaggatccaccaccaccactcccatttttaaaatattctaaatattcacacttattaacacaaaaataaggtgactaagaaggataatttctgtatttggagataaatttaaaatatctacattttaagggacataaaagttttaatagtgaactgctctcttgaatttatttgaaggaaccctaaacaatttaaaaagaaaataattataaatgtataaattattcctttgttacctttgtgggagtaacattagctgctggtctgagaagatactgggaattatatgctggtgactgactataatatactgaagggccagtagttgcaactaaaaaaaaaaaaagaaaagaaagaaaacactgttaaagtctatactacagttaagactatctaggcaagagctataaatacaaaagcaatagaaattaaagaaagatttaactacataaattttaaatttctgtacatcaaaatataccaatcaagattatcaaatgacaaactagaaaaaaattgctaaatatgacatgaagaataagagaatagcatcgctgtgatcaacaagaactacctcacaagcattaaaaaaggaataaaggagaaagtaactgttgccttttctaagaaagatcagtatgatgtggaattatggacattcagtcacagaaaggacgtaaggaaccaagatgccatctgatggtcaatgcatttgaagtgggcctagaaaatctgcagaaagactaggttgtattttgtaaactaaagctattactgagaatgttcagctcaaaaatcacctgacaaattcatggaaaggatgtcataaataacataaaatgtgttccctggcttaaaataaaaagcacatcaacactcatacagatgtacaaactgtctgctccctctgtttggtctgttttaccaggaaacaaaacgactagaaggcacccatgttaatgacaaaactaccaatagtcatttgcttgaactgttttatgatagttttaccagaaaacaaccaaaagaccttttatgcctgtacatggaagaagaaacagaaactgtgccaagaggttccaaacaattgcctctggaaagcactgaaaaatcaagacctagaaaaggctagccagaagcccaagtttgattttggaaaccttacagaggtgaggataactattttgaaattactatggggaggaagcaggcacagaacacagaacaacctgacagaaatggcccaagaatcttaaagtcttgcaaaatgtctgtctgcatgaaagcaaaaagaaaaaataaaatattaaataaaaaaaaaatcttagtctgaagtttaagtagggactttaattgactactgactctaaactgtgaggctctaataaatatactaaaagtaatctaattttttaaagcaccatatgaatagacaatttaggaaagaaatgttaataggcctcaaggaacatgtttttgaagtgagccttgaaaatctgcaaaatgacaaggttgcattgtgcaaattgaagctattatgagaatgttcaagtcaaaaaaattacctgacaaattcatgcacaggatctcacaaggaacacaaatgtgttcgttggctttaaaaaaatcacattaacattcatgttgatatacaaaaactcttctccatctgttttgtgtgagttttaccaagaaaccaaacaactggaaggtacccacgttgaagatggcaaaactaccaactgccatttgcatgaattgttgagcatgactagtattaaaaaaacttaaaaattgatataacttttgttcctacaaattggcaaaggattttataaactagtaagtcagcattagcaaaagtgcgaaaatggcactatcagatactagtggtaagagcataaactgaatattttgaataccctacaaaactaggacagtgtcctagaatttgtaatggcataaaccagaaacaacataaataaaggaacagaatttacagtacttccatgtgatgggacaccatgaactcattaatattcaaaaaacatttaagtttaaaaatgctcagaactaaagtaacatttaaaaaacaggctagctcatctacacacaacatagtaacatggtaacaatctcataaaaaatactatatgtatagagaaagaaccagaaggaaatgctctcaaatataagaaatgttaataaggtggttagtttttagttttcttcaccctgttcagtacttctgagtatctcctatgagctcattaatctttaattttaatcatcttattttaaaaaaacaaggaccatcttgatatatgtttacttttattaaggaaaaagaatctatgaacacaggaacagaaatcaggagatcttggctctcgccctttcagtgccacaaagctgttttgtgaacctgtaaataatccatttggagtctccatgtttctcaattgtaaaatgaggatatgctgcttctacacatttcacagggtcattgcaagaataaaatgagacaatgagaatgttggatttacatgcttgtataagaacagaagaccttttatgcctgtacacagaagaaatggaaatcatgacccacaaggcaccaaataactgactgcacacgtcactaaaaaagccccaggaaaggctagccggtttgtttatcctcttacaaggacctatatgatgtgtaaggttttaagaaaacaaggtttgaacgttagacatttcatatacttatctatgacttacgacatttaataagcttgacttcacaaagattttctgttattttgcttgtgttgagaagatactatcacaaaaggctagtggggttgccttaactataggaaccatcacacaaatgtgctcatctaaactagattttattctaaatctttcctgggctaaaaagagaaaaaaaaaagggcactactactaccatttcagaagtctgtcgtacgtaaaaggaacaatttttttatttctggctgcctgggagcaatgtattatactggcaagtgctttggagttacaccactggagtgtgaatctcggctctatcaataactagctgtataataatgagtaagttacctaacctttctttatccatttccttatttataaaaaagggattaataatggtaccggccattctaagttactgtaattaaatcaaattacattcacaaagcacttttgcacatagccaacccacagtaaacactattagtaaccttagttcattaactgtttactgtatactctaataaatgtctgatacacacccacgcccacctgcacatacacaaatgctcatagtaattatgtaaggcaagtattatctccacatttcagacaggttaacttacacagctattatagtaagtgatagagcagaacttaaaaaccctgtatgattcaggtccaaactccttttctttctttatataaccataatatttcaaattaagtaagatttcctatataacgtcctgcctctcatcattatcatcaaaataattccccagaggtgtaggttcttaattaagcatttcttagtgcataactctattcaataacatttttcaatttaaggaataatctcatctcagctcatctgaggtgtggattaagtgttctttaagcctttatatacacgtgatcacatacggctcgttttttctgcttgggattataaaaatctccgtaacaccaaatacagcttttgaagtcacatataaacagacgttgacatgtatattaacaaacatatataaacaaggtgatttcacacgttatctacttaaaagagggaagtaaagtagttttactaaaatatgcgattatgcacttgccagctcacctgttagtggagccccatgaaatgtctgtgacccctgatatccatcaggcaccgagtctggtccataattctctgtgggccaacgatgacgggatgctgacttactgctatttagtttctattggaagaaaaaaaaatcaaataattttaatcatttaattatatcatgccagaaacagtgctggggaaacttactcttttaaatttaaataactgattttttctttttttcttttttgagatggtgtctcgatctgtcatccaggctggagtgcaatggcacaatcttggctcaccgcaacctccacctcctgggctcaagcaattctcccacctcagcctcccgagtagctgggattacaggcgtcagccagcacacccggctaattttttgtataatagtagagatggggtttcaccatgtttgccaggctagtcttgaactcctgacctcaagtgatccaacacctcagcctcccaaagtgctgggattataggtgtgacccaccacgcccggacctgattatatcttttgaaagtttctatttgccaatgagttctaggtacctggtgctgattttaaaatatgattcttaatttgttaaaaatttatctgctcccattttcattcgttaatacaaaacctaattcattaactctctcacctaaacaaataacctcctaaatgatcacaccttcatttccattctacacttgcctacattaacctttctgacattcacctccagccaagacaattccctgctcaaaaaaacaagtacctacaaactaaacttctttccccaactttcacagtcctctaacattacactgaccatcctttcagtgtgttctttctatactgcaatctggactacctgacattccaaatcacctccccaaattagcttttcacttaaccccatgctgaaacaaaatacaactaattctccaggtgacgttcaaatgctccaccaggaaagggaaaaaagcagtagctgcagataatttattatgtatataataatacgtccaatgcacttaaactcttaatttttatactatctacactgttaggtaaacaatattagctcctatcttaaaatgagagaaagggatgcagggaataacagctggaatttgaaccacatctgactccaaaaatgttctcttaacacaactctgctgccttgacaagatggcagatagatacaatgccgtctagtgtagctatgtggctacctgatctctgctgaagaaaactaaatgacagcaccatacccaaccctagaacctacaaaatgtccccttacaaaacagacacttaacaggaaattctttttccaaagaaattgtagtggtatcagaaaacaggtaaattttgaaaagtttcaaacttctctgtatcagcccaggaatccgaccagttctaacaagtgaggtcagggacagatctagcatgtctgctttctttttctacaagtgtttcaaataaaaatttcccagaaagacctaaccatgaggtccaaaactatctcaattttcaagctaaataaaatttcccccactcatccatctacagtgcctagtccagatgctacacatacacatccaagaaataagaaactagtggaatcacctagaaaactttatggtcactgttggtatccgcaccagagctttgaatttgcaatcactgctgtaactgtaatttttaacattcagtgtaatgagaactggcttcaataattctctcattttaaagataagaagccagtcacgaaggaagtgactggcccaagatcattaattaatggcagagtcagtactagtaccaagcttttcaagctcatggactagtgctccactatacttccacagaatacaatgttgggagcctgaaacctgtatgttaagtcaaaattgtatgtaattgtcataggccatgactacacagaattaacattcaagatttttgtgcaaattcaaaaatgtcttccccaccaaatagtattctcttaatttgcaaatactgctgatcacactgtaataatcgccacacatcagcatatccttgatgtaactttagcagtataatttagttcttgcctgataaacatgaaagaacctacttttatttccaattccaaaaaagtcaagctcctttgaaccctattgttaaaataagatatatatacataactatttccttacataattaagtcaaattcatatggaagtattaaaatatagcaagactttttgaagctcagaccacttttcaattcctagctatacatttgaaacacatgtaatccacagctaatctgagaatgaactcatagaccagagtatgattagtacactgtagcagttcaatcactcgggaaccttctctgtgtcaggaactcttatattttaaataaaacagtttctacctttgaaggtctcaaattttgtggaagatgaggagagagacacataaagtactttcaaaaatatagtaaagggctgggtgtggtggtttacacctgtaatcccagcactttgggaggccaaggcgggcagatcgcctgaggtcagaagttcaaaaccagcctggccaacatggtgaaactctgtgtctactaaaaatacaaaaattagctggtcctggtggcgggtgcctgtaatcccagctactcaggaggctgaggcaggagagtcgcttgaacctgggaggtggaggttgcagtgagccaagatcgcaccattgcactccagactgggcaacagagtgagactccatctcaaaacaaaacaaaacaaaatatggtaaagggtcaagaccaaggtatgtaggctgggcacagtggctcacacctgcaatcccagcactttgggaggctgaagcaggaggattgtttgagccaggagttcaaggccaccctgggcaacatggaaaaatcccatctctacaaaaaatacaattagctgggcctagtggcgtgtgactctctgtagtcctggcttcgtggcaggctaagccaagaggctctcttgagctaggaggtcgaagccacagtaagctgtgatcataccactgtactgcagcctgcacaacaagaccctgtcttaaaaaaaaaaaaaaaaaagaccaaaatgtccccttgccatactatttggatggcaaggggacattctgaccagcttcagaaaaaaagtgagagagtggccagggaaggaatcttggaataaaaagtacagctagagaaattaagtgacttaccgtaatggcctttacttcttggcaaatcattttccgtaaagaattctgatcttctgcccatcgaggtggtgttttgggagaatactaaaaaaaaaaataaaaataacaaaagagcatttaaaacacttagaaacaatttcacaatgaaatgattccattctttcctgtttaccttgtaacttttacttggtgatagtgaatatttggtaggagatggtgtagaatgttttatttctgaatctgcatttcgcaaagaaccatttttatagagaggacctccttcactatagtcttcgagttcctgcatgactgacttaagcatctcttttacagactccaggggcacaggcaactaaaaataaaagacattaattaagggctttcatttgcaaaaaattccaaaagtaaaaactctaaaatgatatattttatcttatttacatttttgtcattttaataagcactttacactttaaataataatacacgtgaaagtgttttttaattatcttttttctttgtttttctgctgttttgtattattatttttatttttttgtctttattctatttttttcttcatgaacacagaaaagtgttgtacaatctaacatcttctgattctaaagtccatgctctttctattacttctgttaaccatgataattgtagaggaatgttaacttggaaagcttttccaagtgaacaaaataagttactgatgttttctaactgattttcaatggtgacagaaatacagatgctacaatacaccagacaacataaatcctaataaaagagtagtaacacaaattaatcaacaaaacactcagaagactgaacataatttaacatcatcatgacaatctcaaacagctgacagcaagaaaacaagggcgttcataatggctgatgaggatgagaagaaatgctcttaagttgtcagcaacaactttcaatttcagcaaagttcattaagaattagtcctgaggttataatatttgttttgattacactgctaagataacacctagattcccaagtttaaaaagacacaccaaacctaagacaaagcaagcaaatataagcatttagacacacacatcccttctgtgcattaataacaacatattactgagtatttttgaaattaccaaaatataagaccaacgcaaaaacactgaccagtgggttatcagtaagaacgtacatacaacaacctgctacttactttcttgaccactgaaagatttgaatcactgtcatctataatctttattaggtagtccctggtctttctcagataatttttgcattcttcttgttcttcaggaaaaacggcatcattttcaatgtcttctgctttcctgtgaaaaatctatacaaatagtgcttttatgaaatcattagctttttaaaacaaaaaactttcagcttggccacgcatggtggctcatgcctgtaatcccagctactcgggagctgaggcacaagaatcgcttgagcctgggaagcagaggttgcagtgagccaagattgtgccactgcactctagcctggccaacagagaaaccccgtcttttaaaagaaataataaataaataaataaaacttttagctcaagtactgcatctacttaccagtgcaagattccaataagaaacaacactttttatagattcaaaagcagtcacagcatcttctatatttccatgtactgcatccaatatagcaaaagttatgtgtgcatcttcttcatactcaacaatttctgatgcctaaacacacagaatagtttttagtcaaattgtttatactcagaatataaaacccaaatgattttccaaagattttatatgatcttaagagacaaacatctcattactcttctctgtcatatcttatctgtgagagctagtgaatttagaaaacaagattaccgttaaataacaaggcaattaatttaagcagtttatagctccacgtctttgtttataaactggaaattcccatctccaataaattcataaaggaactctgttacctgaatgtctacactatgaaaatgtttaaacagaggatcaataggttcaggaatactgttcttctttattatcttcaacaatggcaaaactttcttccaataatgaacacttctccctatgtattcttgttgatcataagaagaattaagacccctgccctaaaaaagaaagttaaaagcacacaactttaaggaacacgcatgattagatctaaagttcatttacaggttgtaagaactggctaaaatttcaagtcaaaaccaaatggtacctcaatagtcatttgttcaacttccaaatactgtaataactaaaccaccttaataccagtgaactcactgcaacctctgccgtgcaggttcaagcaattctcctgcctcagcttcccaagtagctgggattacaggcacctgccaccatgtctggctaattttgtagttttagtagagtttttttttgtatttttagtagagacggggtttcaccgtgttagccaggaatgatctcgatctcctgatcttgtgatctgcccgcctcggcctcctaacgtgctgggattacagatgtgagccaccgcacccggcctctacactcaacttttaaacacttctaatgataccaccctaatgtagcaatcccaactactttttaacagttgccatttttagatagctgaaacctgcctcttctgtagtgtcagtttgttcaaaaggctgaccatcttcacctaatggtgacacaaaacaaaccttaaatatttagaaagatctataatggtcttacctacaaagccttgtgctaatttttttttttaattttcaggctgaataattatcagaacttaattattaaggaataacagtaacagctcagctaatatgtaacattcactgtgtgccaggcattgctcctctaagtgcttatatttaactacattaactattttgcagcaataaaaaacacatctgtcataatatgaccaagctgctgttttctgaacaaaaaaactttcaataaaaagtgcatgattttaaaaaattaaggtaatgttctttaaaaatgcttatactttaaaactcaccattttctgaaggcattttgcccaatgtacaagcagagcaggttgaaggccatgtttttcctgggctcttagagtgtttatttcatgctgaactacaagtctcaattctgctgagtttccaggtctaaaaaatacttcaatttactaaaattgttttctaaatacacagttcagcgcttacatacatatatgttaatgggtcacatgacaaattaaatcttcacatgaggattaaatccccggtaaaacctacgcactaagtgaaagcaatatttttgttttactacttacactgcttttctgtgaatcagagtacaaaccgcatcccaccaagatttttgtctctctgtacaaagccgtttacacacaggaaggggcaggcataacggctgataggagctgtggtgagaattacatttctcctttaattgtaagtggctggtatatactactccaaggagaaatacctgttttatttaaggaaaagttaagttagaaaaaaaaattaaacaaaattcagaatatttaatttgttaaaatctttgcttacttcaagatctaaaatacatattgattcaggtgcatttgtttcaagccttgaggtttcctggggcaaatgatggaaaagctgttttagccattttcggattccaggtaaagcaggcaatgaattccactgtaagccaagccaagtaaggtgctgaagactaccattatgtgcttgaatagcacctgaaataaaataaaaaaattggcttaagggttcgaaatttttctttgtgccattagttttgccaacataaacaattcacattatatatatcttaattatataactgcttttctatatcaaagctggagggaattctatgttaggcaaaatctcatgttcttattaaatgcattctcacttgattatttctagaaattttaataaaaatagtagtgatgaagaatgtttaagtccatcttaaaaaatgacactgactagaactcaataaaccaaaatcaactgacaaaagccaaataaagaacacctaacctaataagaaaccccaaaacaatgggttttcctttaagtcattaaagcaatggaacaccactatattaatccatcggtacagtaaagaaatctgtttttctacaagaaagtcaatattgaaaaggttatgtgcagtcaggagttcgagaccagcctggccagcatggtgaaactccgtctctactaaaaatacaaaaaattagccgagcatggtgtcacatgcctatagtcccagctacttgggaggctgaggcaagacaattgcttgaacctggcaggcggaagttgcagtgagccgagattgcaccactgcgctccagcctgggtgacggagcgagactctgtctcaaaaaaaagaaaagaaaagaaaagaaaaggttatgcgcttctggaagcatgaagaggtataatctttctgtcattttggcaatttgcaagacttaaagatgttcatgtcctttgtctcagtaattctgtttttaggtatctctatggaaataacttgcaatgaagacactttttgttgaagtttttatcagagtatgattattaacagtggaaaagttgagaaaacttggatgcccaataacagaaagttgcaagcaaattatgactacttcataaaaaagattatattgccaataaaagtgatatttatagttttaatacagagactatgggagagaattcatgaaggaagcaagataaatcatacataaacaaccatttagatgaaaaatatggtcagatgcagtggctcatgcctataattccaacacttttgtttttgagacgaagtctcgctctgtcgcccaggctgtagtgcagcagtgtgatcttggctcactgcaacctccacctcccgggttggagcgattctcctgcctcagcctcctgagtagggactacaggcacatgccaccacccccggataatttttgtatttttagtagagatggggtttcaccatgttggccaggatggtctcgaactcctgatctcaggtgatctgcccgcctcggcctcccaaagtgctgggattacagatatgagccactgtgccaggcctaatcccaacactttgcggggcttaggcaggaggatcacttgagcctaggagttggagactagcctgggcaacaaagggagaccctgtctctaccaattaaaaaaaaaattatctgggccgagtggcatgtgcctatggtaccagctactcaggaggctgaggcaagagaatcccttgagcccagaagttcaaggcagcagtgacctacgatcacgccactacactccagcccaggtgacacagcgagaccctgtctcaaaatacaacaaggctggtcgcggtggctcactcctgtaatcccagcactttgggaggccaaggcaggtggatcacctgaggtcaggagtttgagaccagcctgaccaacatgatgaaaccccgtctctactaaaaatacaaaaaattagccgggcgtggtggtgggcatttgtaatcccgctacttgggagactgaggcagtagaattacttgaacccgggaggcagaggttacagtgagccgagatcgcaccactgcactccagcatgggcgacaagagcaaaacttggtctcaaaaacaacaacaacaacaaaaaatacatgccacccctacagcaccacattcaaactccccccagcccaacccacacacaaaaggaatacaggaaaatattaagtcgttatttctgggtaataagattatgggcaatttataataattaagacggagaccatttcctctgaaacatataacttaccaacatcgtatctagccaaatcttcaagctctggttcttgtacatcaatgtttccaatatcatcgctaccaagaaaagatgtatccttagatgactgactagaaaacagagcattatataacacagactgcccgcttttgttggcaaaagtttcaacaacctcttttaaaaaatcttgcttgccacgacttaagtttagcaacatatgccctgaaaaaaaaatttaagttatttccatcactttaaaaatacagattgtatttgctcacgttgtctcatttgtatacccaaaggggaaataacatgattattgcagacctaaccctccaacccaaaaaatacagctggacaacaaaacgggtgcttatgtagcaaatgaaaagagtacaggtttaatattctcagtatctacataagacagcagaagggggaaaaaagacaggaatgtgtatgaaaaatgccaaacatatttgcattttagatgaaaaggtctggatttaagtggccataggagaacagggacaagctcttattctctgatctgatacactgatttctgaacctggctgatcagaatcctcctttaaacagcttttaagaattatttccggctgggcacggtggctcatgcctgtaatcccagcactttgggaggccaagctgggtggataatgaggtcaggagatcaagaccatcctggctaacacagtgaaactccgtctctactaaaaatacaaaaaaaaaaaaaaaaaaattagccggccctggtggcgggcgcctgtagtcccagctactggggaggctgagggaggagaatggcgtgaacccgggaggcggagcttgcagtgagccgagatcacgccactgcactccagcctgggcgacagagtaagactgtctcaggaaaaaaaaaaaaagaattatttccaggccttgttcccagagatttttattccataggtttacagtaagcaatcaaaaaatcatagtcctcggataaaatactgatacatgctataacacagatgaaccttgaaaaccttgctaaatgaaagaagccagtcacaaaagaccacatactacatgattccatttatgtgaaatgttcagaagaggcaaaccggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaagaagaggcaaacctacagagacagattagcggttgccaaggctgagaggtttgggtaaaatggggagtaactgctaataggtaagaaattcctcatggagtgatgaaaatcttctaaaactgactgtggtgacagtggtaatactctatgaacatagtaaaagccactgaactgtacactttaaatgggtgaagcgtatggtacatgaattatatttcaattcaactttttttaaaaaccctcctttgagttaattctgctgggcaattaggtttggttaccactacacagttgtgtctcagcacacttacagaggcaccctcgggatgcccagatcaaagacataaaaaaaaaatacaggcaattttcatctaactgtgacaccatgcaaaggcacttatgagagccctgcaagggtagaaggaaaagagaaaaggaaaaaagtagaaagtcactttaaggactgaaagcctagctcccacaaaaaaagtgggctatggaataaaagagcaatgtgagctttggccaacagcctaactatacaccaaagcttataataactttgatttaatattacatcttgctctttacaaaattcatccaattttatatcaaaactgctccttataggaagcattatgtttcttcagttcactgcttgattcaatggccatctaactaccttaaagtttgtatcttagcaaaatcacaggtaatatgcaacagacctttaggattcatcccaagccaaaaacgggggaaaaaaatccacaaattccaagagcctaatataaggtaagtatatatcttctatcttcctcactatgctctcagctctttaagacagatccgtatcttcttcatctttatatccccacagcagtgtttttagaatcagctggtgttaaatggttggcaaatcaataattatacttagttcaggaagtgactaaatattcaggctagaggctctagcagccagatgaagaaagagttaagaaatcctctccacataggaacaaacaatatcaaatattcattttttttaaagaatgtgctatttcttcgcatctcttccatacctattgctcttaactgatacggcaaaaagaaataattttgacaaattatctcctggacagatgaagattttatcataagatatgccttaacagaaattcctttttctttttaaattaaattagtttaatattactattacctgattggctcagtcggtcacaggccatcatttccagcagattttgtccagcttcaccttttattaatttaatctttggtcttggaacctaataattttagaatcaaaaatcttaatttgatgatacccatacttctaatagtaacatggtcttgtctattacactgtactttttttgataatgaataaacagttaaccattaattaaactgaattggaaaagactgcaaaaactgggaaccaaggaatttatataacctatgaaagataggccaggtacaggcgtggtggctcacacctgtaatcccaacactctgggaggccaaggtgggctgatcacttgaggtcaggagttcgagaccagcctggccaacatggtgaaacccagtctctactaaaaataataaaaaaaaaaacaaagaggcaggcgtggtggcacacacctgttaattccggctacacgggaggctgaggcacaaggatagcttgaacctgggaggcagaggtcgtagcgcgccgagactgcgccattgcactccagcctgggtgaaagagcgagactccatcgcaaaaaaaaaaaaaaagaggggccagacatgttggctcacacctgtaatcccagcactttgggaggccgaggtggggggatcacttgagcccagagttcaagaccagcctgaacaacacggtgagaccctatctctaaaaaaagttttttttattagccaggagtggtggcacacaactgtggtcccagctactcaggaggctgaggcaggaggatcacttaaatccaggaggtcaaggctgcagtgagccatgatcatgccactgtgctccagcttgggtgacagagtgagaccctatctccaaaaaaagaaaaaaaaaaaaaaagcatacacagagcagctctgagaaattagtttctactaaaagcacattcgtgttacattcagagaaatggaaaatttaattatattacttttctgccctgaataaataggacaacagcagatgttgtcctatttgagtagatatgacaccctactttaaaaagtacaggtgaaatgacacttggaaatgccacattgtagataacacattttcagagtatggataacaggggatagcactagaataaatgggacaaccaggaaattaaagagatcctaatgcaataacctatggaaaaaaaaaaagcatgatgaatagaatggcgaagggaagacgtgacagctgccttcaggtattaaaattattttataaaagaaatcatcaaaagaagaaacaagaccaacaggtagaaggcttgaagaatatttttattctatataaggaagtaccaagagccaaaccacctaaagatgcactgggctatcttgaaaagtaatgaatgcccatcactgaaaacgtccagtcacaggcaatgcccacttactagaaacatgccaaaagtaactatatgggtgactagagcatcggcttttaattctatcaccactttcttaattggtggtggaaatgtaatttgatacaacctctttagggttagatatttggcaacagctctaaaaattataaatgcacagatatactttgatactgcaattctttcaggaattcatggcacaagttaatcattgctaaattacttgaagtagcattaaaaaaaaaagtaaaagcaagctaatgtcctggttttaggaccctggttttaaaaactccaaaactacagtacatccatacaatggaataatatgcaagcatccaaactaatgagaatgccctttatatatactgacatggaaacatctccaagatacagttaatggaaataaagtaaatgcaatgttcaaatgttttcctccttcctttaaagacaggggatatatgtgtgtttacttggagatgcataaaacatttcctgaagaacacacaagaaagcaataacattagtttctttggggctggagaaagtaaataactagggaacagaaaggagtcttcatagcatattcttaagagccgccagaattttaaaccatgtatatataattctttccaaacatgctcatttttcaaaatatatgatttatgaacctaaaagcttctgattttgaattttagaaatattcatatcgcctatccttttactcacaagttttctaaacatcatgtcaaagtttgtcatctatatgttgaaaagagcacacaaagtaagaaacaaaatgttgacatcattctttttgttttcaaactgacctcaattcataaacccggcctcttttacaaaattattcaacagttgaatctgtgaccagttaattagttgtgaatccactcaatcaaatcatctcaattcactatttcctcttttttttttgagatggagtctcgctccgtcgccaggctggagtgctgcagtggcacgatctcggctcactgcaatctccgcctcctggtttcaagcaattctcctgtctcggcctctcaagtagctgggactacaggcacctgccaccatgcgtggctaatttttgtatttttagtagagatggggtttgaccatgttggtcaggatggtctcaaactcctgacctcaagcgatccgcccgcctcagcctcccaaagtgctaagattataggtgtgagccaccacgcctggctatttcctcatcttaactaaaaggtttcaagatactttgttaactacctagctgcaatgcagatgcacttactagaaccacagtattcctctgattaagagtctgaaaatcttgccataaaagttagccaattcttaaatacccaaatgccagcacataacctacattttatgcttataatcatttgttcattaagctttaaaataaactgatcaaataaaatacaagcatctaagatgtttctattatatattcattctacagaaatatgtggtagctaataaagactgaggtaggtatctctgtgctgaagtggaacaatgaagaaacattcagaaaagcaaggcatctggcaataggtaaagcacacccacattgaggcacaatattttttaaaagcagagaaagaatgtattgcacatttgcatatgcaaaaaatatttctgaacacccaagaaactcctaacagtagctgtcatctaggaaaggagacctgagtgaatggattaagagggaaactaacttattatgattaaaagttcacagtcaggtgtggtggctcatacctgtaatctcagcactttgggagggcaaggcagaaggatcacttgaagccaggagttcaagaccaaccagcctgggaaacatagcaagaccttgtctttacaaaaaatttaacaatgtagccaggcatggtggcaggcacctgtagtcccagctactgagctgaggctgaagcaggagaggatcacttgagcccaggagttcgaggatgcagtgagctatgatcatgccactgcactccagccagagcaagagtgagactctgcctcccaaaactacatatcgaaaaattttaggctgtgcgcagtagctgacacctataatcccagcactctgggaagctcgagcccagttcaatgttacggtgagctacgattacgcaactgcactccagcctgggtgacacagcaagactctaatagacacacagacagataaattttaaagtttccattaaaaataagaactattggcagggcgcggtggctcacacctgtaatgccagcactttgggaggccaaggtgggcggatcatgaggtcaggagatcgagaccatcctggctaacacggtgaaaccccatctctactgaaaatacaaaaaaattagccaggcgtggtggtgggtgcctgtagtcccagctactcgggaggctgaggcaggagaatggcgtgaacccaggaggcggagcttgcagtgagccgaggtcgtgccactgtgctccagcctgggcgacagagtgtgagactccatctcaaaaaaaaataaaataaataaaaataagaactatcagttacttgagaatttctataagaaccttttaatgtttgtattacctagtgaacctcactaaatccattaattttcactaatccattccttatgaacacagaagtttctactgagccaatattagcatttaacatgtgaactgtctatcaacggtgtttttaaaagatttacaggccaggctcaatggctcatgcctgtaatcccagcactttgagaggccgagtcgggtggatcacgaggtcagaagatcgagaccatcctggctaacatggtgaaaccccatctctattaaaaaatacaaaaaattagccaggcatggtggtgtgtgcctgtaatcccagatacgtgacaggctgaagcaggagaatcacttgaacccaggagacacaggttgcagtgagctgagattgcgccactgcactccagcctggtgacagagcgagactccgtctcaaataaaaataaaaagatttatattaggcagggcatgctggctcactgcctgtaatcccagcactttgagaggccgagacacgcagatcacctgagttcaggagctcaagaccagcctgaccaacatggagaaacctcatctctactgaaaatacaaaattagatgggcgtggtagcgtgtgcctgtaatcccagctactcgggaggctgaagcaggacaatcgcttgaacccgggaggcggaggttgcagtgagccagatggcgccattgcactccagcctgggcaacaagagcaaaactctgtctcaaaaagaaaaaaagatttatattagaaggaggggccttctctaaaagtaatgaatccttttttttccctccccaagcaaaaaatccttctctaaaattaatcatttttctaagcctggtttaatgctttttttggaagactgcttatttcttttcctttcaaaagttatgcaagctcattaaaaaaaaaagtccgggaatggtggctcacgcttgtaaatcccagcactttgggaggccgaggcaggtggatgactaggtcaggagattgagaccatcctggctaacacggtgaaaccccgtctctactaaaaatacaaaaaaattagccaggcatggtggtgggcgcttgtagttccagctactcgggaggctgaggcaggaaaatggtgtgaactcgggaggtggagcttgcagtgagccgagatcgtgccactgcactccagcctgggcgacagagcgagactccgtctcaaaaaaaaaaaaaggccaggcacgccaggcacagtgcctcgggcctgtaatcccagcactttgggagaccaaggcaggtagatcacgaggtcaagagattgcgaccatcctggccaacatggtgaaaccccatctctattaaaaatacaaaaaattagctgggcttggtagcacgggcctgtagtgccagctactcgggaggctgaggcaggagaatcacttgaacccaggaggtggaggctgcagtgagccgagatcacaccactgcactccagcctggcaacagagagagacttggtctcaaaaaaaataaaaaaataaaaaataagaaaaggttttatgttttcaaagattaatagatatactgttacatatacacaatacagccataaatgttatatacatgtgtttcaattaacatgttaaattgcaatcatattcttctatcataggctataaagccattgccctacatctacttattaggattttgtccaagtaacacacctttttgaatcaagctttacccataatacgagattacatctttatcatgttcccaaaaatggcagagtaaaaagatcaaactcttcaaatttgtctacaaacaaatcatggcaatgcaggctttcgacaagagtgcactcaacatccctgtttcaccagcctcaccagtattgtgtatgcttagttattttccactgtatcaaattgactatttcattttaattccacagtttgttcacatattgtcattacataccagagcacaccttcatttaaaacacatcaagactccgtgaaatgtcaattgctcctacaagtggaagacttacctgaaatgctatgacatagcacaatgcagccagctcagaaagagcttgccattgaacattattaccatgctgacccatcttcaagagcagagaaccagcatgcatgtagaaatgtcctttcatttctaagaaagtagctgacagttcatcatttccacccaaagaagattttgcagactgaagagcactatcaaaactgtaatatgaaaatatcaaacagatgatacacacttactgcactgtgaataatcatggttcatttaattcaaaacaaaataaaaattttatttcaagcttcatcttccacattcaacttctaataattcttattccccatgttataaattatgaatcatctaatgcttatttttatcctgcatacttcctatacttcatgcttaacctctcaaatgatgtcttattcccagttatttccagccctccaatcacaggataaatataagattagtgattataggtgcacatttcaaaataaaccaggataaagttgggagactattttgtagtttcttcctgatcatataatttcattatttaattaacagttgtaatttctcaaattagacataccatttccaaattataagtaagtaactgacaggtatttgagtatcaatacagcaattgctctttttactatatagatcattacagcgttaaattgttttttttttttttttttttttttgagacagagtctctcactatcgcctgggctggagtgtaatggcacgatctaagctcactgcaacctccacctcccaggttcaagtgattctcctgactcagcctcctgagtagctgggattacaggcacctgccaccatgccccgctaaactttttttatatttttagtagagacagggttttactatgttggccaggctggtctcgaactcctgacctcacgatccgcccgcctcagcttaccaatgtgctgggattacaggcatgagccactatgcctggcctattatttgtaatctatattctaaattagttcttctaaatcctaatgtttctccaaatcctcactttggaagaaaagtaaaagcaaaaagcaaacacttaaacgtgaagcatgattttaaagtggcttacaataacgcaaccagagcaaatgaggtctaaagatctctgagggtgctcaaaaaccccttcaggggatccatgaagttaaaattacttttacaataataccaaaaaaaaatttatatattacatactcattttctcatgtatgtagagctgagtttttttgtttttgtttttggagacagaatctcactctgtcacaaggctggagtgcagtggcacaatcttggcttaatgcaacctctgactcccaggttcaagcgattcttctgcctcagcctcccgagcagctgggaatataggcgcgtaccaacatgcccggctaattttttgtatttttagtagagacaaggtttcaccattgttagctgggatggtctcgatctcctgacttcgtgatccacccgcctcggcctcccaaagtgctgggattacaggcctgagccaccgcgacccgctgagctgagttttctagaggcttcatgacatgtaatagttttacagactgaaagaggaagtaaatgagaatctagctatgttctattaagcgagacattaaaaagatttacaaaaatgcaaaaacaatgacacttttctgactacttttttgctgttggaaaataattatttttcataaaaaatgctattattggccctgcgcggtggctcacacatgtaattccagcactttgggaggctgaggcgggtgggtcacctgaggtcaggagttcaagaccagcctagccaacatggtgaaaccccatctctactaaaaatacaaaaaattagccaggcgtggtggtgggcacctgtaattccagctacttgggaggctgaggcaggagaatcgcttgaacctgggaagcagaggttgcagtgatccgagatcacactgttgcactctagcctgggcaacaagagcaaactccgtctcaaataaaaaaaaaaaaaaaaaaaaaaaaagctattattattaacacacaatagggcttattacatttttaatggattacattttttatttgttttaatttctaatgtaataaacactgacagaaataacccacatacggccaggtgcagtggctcagacctgcaatcccagcactttggaaggccaaggcaggcggatcacgacgtcaagagattgagaccttccagtactttgggaggccaaggtagacagatcaagaggtcaagagatcgagaccagccgggcgcggtggctcatgcctgtaatcccagcactctgggaggctgaggcaggcggatcacaaggtcaggatatcaagaccatcctggctaacacagtgaaaccccatctctactaaaaatacaaaaaattagctgggtgtggtggcgggcacctgtaggcccagctactcgggaggctgaggcaggagaatggcgtgaaccctggagacagagcttgcagtgagccgagatggcgccactgcactccagcctgggcaacagagcgagactccgtctcaaaaaaaaaaaagatcgagaccatcctggccaacatgatgaaaccctgtttctactaaaaatacaaaaattagccaggtgtgggctgagcgcggtggctcacgcctgtaatcccaacactttgggaggccgaggagggcagatcacgaggtcaggagatcgagaccatcctggctaacagggtgacactccgtctctactaaaaatacaaaaaaattagccgagcgtggtggtgggcgcctgtagtcccagctactcaggaggctgaggcagaagaatggcgtgaacctgggaggttcacaagggggggtaacaaagggcccatgagtcctgattaactgatctgacaaaccatctgtcacccaccaccctaagccacactgtgaaactgcctagggtggcaccagctttttatcttcctcagggtcctcccctcaggcccccaagtcaccccctcatggtccggattctcccctgagtgactccatccccatggtcatctcccctcctgagcctccccctctgagggccaagggctgtcctcagggccctcctggggcttcctggtggggaacaacctgaggcaggaggataagctcttattcagagcattgagaggaaattgtgaagcttgcagtgagccgagattgcgccactctactccaggctgggtgacagagcgagactctgtctcaaaaaaaaaaaaaattagccaggtgtggtgtcgggcacctgtagtcccacctattcaggaggcagagacaagagaatcacttgaacccaggaggcagaggttgcagtgagccgagactgcaccactgcatgccaacctggcgagagcaagactcagtctcaaaaaaaaaaaaagagagattgagaccatcctgaaccccgtctctactaaaaatacaaaaattagctgggcgtggtggtgtgcgcctgtggtcccagctactcaggaggctgaggcaggagaatcgcctgaacccgggaggcggaggttacagtgagtcaaggtcatgccactgcactccagcctggtgacagagcaagactccatctcaaaaaaaaaaaaaaaaacaaaacaaaaaagaaagaaagaaagaaaaaaaggaacccacatacaaagatctttgatgtccttaagaaaaatgtaaaaggaacttgtgaccaaaaaatttgagtatacaaagaacacaaaataaaacatcctacatgttttctaaaataatcttaaagttatgttagttcttttagatactgctcttaccctaccaatttaggacactatgtactttttcaagaaaattacctactccctgcactcagtgaaatgaacttctttccttataccagatggggaaataaattaacttccaaacaaatggacagcctaaactagcaatcagtaaactttttctacaaaaaggaggagattactaatctggctttacaggcatacaatctctgctgcaaccactcaattccaaccttgtagtatgtaagcagccacagacaatacataaacagaggcatgttgcattccaataaatattaacaaaattaggcaggggccatatttggcccacaagttctaaccaacccctgctctaaactaacatttttatacaaatccaagtgatgtttttgttcaatggaatttattttcaaaatggagacactggttttcaaaatcaaaatttaggaaaaaaggtaaatcacatagttgagttattttgtttcttagctaaaacagtattttctgaaataccagtgatgctaagtgcttatactagtacatgtgaacctagccatctgatgacagatgaaccttaattttcactcaagattatactattataaaaaataaaatatgaaatagcagttagaacattcattttaagcttgactatgacaaacctgagtatttaaccataaggctaattttaatcaagcttgaactataagagttctctaaaaaggaaagtcatataaaaccaattagaacttccccgtaaaagaagaaaaataagattgcctcctagtggttcactgtattaactataactcctaggtacattatagaaataatgatgcagtaaagaaatttagagcaatgaacttactgcaaaaagaaaaactacaatttatactaaagcattctcctcaaagtcaacgcacctttccagtaattctctactttcctgcacatctctagtggaaagcgtaagaagcataagattagcataggccagcagtaagtctgtattggttgctcgccagtcacttttatcagactccaaacactgtaaagactccagatattcctattttgtggaatgaatagtaagttacaaaacttaatcaagtgttaagaaattaaccattttatgcctacaaattccttttctcactctaaccacgtttgtgaaactacattgatttttacatcaaccttataaatgaaaacaccaaaaatatatacatttatcatagttatctccccaactttcccattataaatttaactgatcctggtaaaaatttcattttataactgttctacctaaataaaagaaatttaagtcctgcggggcactgctgctttagtacaaaaagatgtatgctaattgcctacatagaaatgtaaagacccaatagcttttatctaccttaagggtctgtacaacacacgaattccactctaaacttgaacgcaaagctatgttcctctctgcctcatggcagcgggccacagcatccttcaatcttttatttgagcgatacaactccactagccggatgttcatatggacgtcatcaggtcttacataaagttctgactgaatccagtcaaaaagtttattccatccatcttcaccttcacaatctagaagatgttcctatttagaggggaaaaagaaaaattattagagtaacacttgtgcaattttaaacaagtcatgctcccaaaaagcaccattccactatgtctagttttatgatgatgccaccaaaaacaccatcctatataccttattcgtcccttctgagagttgcttacaacccagaaactaagcctcaagaactgtatgtgaagaaaagcatctgtgattactgcagtagcttatactctcttcagagactaccaggactattgccacacatccctgtccatctgagtcaccaccagaagcctagacctccccagtcaatcctcagcaacaaggtccttatgctcaaactgctctgtatctccttaaatctgactcaatcccacatcccctctcctcccactgttctgttaccttcatcatcatctcaaagcactgtcatcacctcctgatcttaaatgaagacagtatcatctcaggataacccccactaccatgatggctttttctctctgaacttacatacaaggagaggaagtagggtttgtggccactcgcttctcatttgcgatgctcttccatcagcctctcaagaagctaggaccataggcatgcaccaccatgcccggctaatttttttttaacgttctgtagagatggggtcttgccgtgttgcccaagctgactactcagttccttaatcacctcatctccagtcatgttatcctctactccaacctcaaccatccacttgccactgacacaggtcttcaaaatctgcattttggtcataccaccgaaacgaccataccatccttcttattcttccacctcactgagggcctacgtacccttactttcagaaatatacttctccaccacatgacaagttcccttcaagacaataacatcatcaagttttaagcacctgtaaacacatataaatacacacactttcttctgtcaggcaaaaaatgctataatcccttatatccataattactgtttgcttacagatcccttcaactaattccctcttttcctcagaaccctcccaactggtttctgtgtgcttagatttgggaaatcataaccccaagctaaccgatttcatttgcattatctcaaccatcaaactggtgctgcctaaaacaaaatgccattttagtactaacagactcactttctccactccctgacacttcacacctcctcctatttcctcaacttccccataccttcctttgaccctcactttcaacttataacctagattcatccttcactgagaaacctgatgctatcacatataaattccattttaccttacctacttaaactcgtctttccccagctctcaagaccaagccgtccattactactctgtatttcattcccctctctcctttatcaatttctcctcttctggatgagatggatgataccctggtctctccctattgcaaaagccctagtctttgactctatgttaaacattttttaaaaaaccactatgagtgcttttaaaaagttctatctcatacttgagagaaaaagccttctcaacagtaatactctcattcattaaacaaatgtcagaaactgtttaccttagcaagccttaaattttaggagaaatggaattactttgcatgacaattataaatctcatggatttcaattccaaaaaaaaaaaaaaatctgatacaggaaaggtgttaacagtgccttcaagttattaaagaaaatctttaaagagtgcttcaaagtatctaacttgttacactgcaagaaaacaatctcctgccattacatatgttctttaacactactgacaccagattaactggattgccacgcccaatatgggagttatgtttgaggcataacacctaagagagtaaagaaatctgcacaattagacctcatgttttagactaatatttaaaatccagctgcttattactggggagaaaaacttatcagtaatatttatctttggaagcatcttcaatgctttttcagcttcaaaaatctggacatgattgttcatagcagttgaacaacagccaaaacctagaaataaccaaaatgcccctcaaaagtgaatggttaaggctgggcacagtggctcacacctgtaatcccagcactttgggaggccaaagtgggtggatcacctgagaacccgggaggcagaagttgcagtgagccgagatagcaccactgcactccagcatgggcgacagagcaagactctgtctcaaaaaaataaaaataaaaaaagtgaatggttaaattgtggaccatgaaatgctactcagaagtaaaggaaccaactatggatatacaaaacttaatatggatcacaaatggtattatgctgactgaacaagccaacctcaaaaggtcacatgcttggctgggcgcggtggctcacgcctgtaatcctagcactttgggaggctggggtgggcagatcacatgaggtcaggagttcgagaccagccaggccaacatggtgaaaccccgtttctgcaaaaatacaaaaataagcgggacacggtaacatgtgcctgtagtcccagctacccggaaggctgaggcaggagaattgcttgaacctgggaggcacaggtggcagtgagccgagattgcgccagtgaactccaacctgggcaacagagcgagactccgtctcaaaaacaacgaaaaaagaaaaaaaaaagtcacacatttcatgatgacatttacataacattttgaaatcaccaaagtataaagatggagaacagattaatggttgccagaggtcaggcatagtgaagagaagtaaatagcatgactacaaaaggggcagcatgaggaagatctctgtggtaatagagtagctctgtatcttgacagtagtggtggtatgaatctacacatgataaaatgaaagaaaactatatacatacacattgtaccaatgtcaaaattcctgattttgatattgtgctttggtcgggttaaacaggttgagtatcccctatccaaaatgcttgagaccagaagtatttcagattttgaattttttcagactttggaatatttgcaggatacttagcaggcagagcatcccaaatctgaaaatctgaaatccaaaattttccaatgagcatttctttgagcatcatgtcagtgctcaaaaaatttcagattttggagcatttaggatttcagattttaaatgctcaacctgtataagcattggggaaaaatgaagtagcatataggatctttctgtgcaatctttgcaacttcctgtgcaaaaaaatctataattatttcaaaattaaaattttttaaatttctatcagaaacatatacaatgggggtaggaggaggctaaaggcaaatatacatttataattttatattgtacatacacaataaagtatacattaatatataaaatattacaatatacattttaaatgtttgccaaacatatttgtgtagattttctccagaacagttacttagtaaactatattttgctctataaagaatatcaggaccagtcaatacactagcaagaacttcctaccatttttagtaattacatcttatatactagagaaaccaccttttatcttttccttgaaaactttactatctcaaaatacaatcccttctactttcagaccatagttattagaaaactcttctttaaaatatccctaaattgtcatcctgtaggtaattttcacttaatgaagcaaaaattgtataccagacagaacttaatgtaaatcttagctctacttagtttacagctactaaactgtaaaatccctaaaatattaattattccagaagggtaaatgagatgtcacttataaagtataacaatgcctaataagacagcagatgctcagaaaggttttaatacactttttaaaagaaaaatgttaaaggaaacacaaacacctgggcttaaggtttgctattgaaaagtaatttaaactccaaatattagaaatggttatgtcttaagttttctccctttatgttttgtatgtttacctttagtttataaattgcaggacttcctgggaaaagtttcgctgccctttcaacccagtattttgctcttccatcagtaacatcatttttacaaagcaattctgcaatcttcaacacaagatctttttgtggtgggtttaattccagtgaacgctaatatcagaaaagaaattaaagattagtaaataaattgtatgtatgtatgtaggagtatatatacttatatacttatatataaaggttaaaaattatcactccaacccttaaaaaattctacttctagagaaaacatgttacttcaaaggtgttaaaataaaagtgtcttggaattttctggaaatgaatcaaataaaaattatatttgtgtcatttgaatgcaaaagaacacaaaagaacaccatttctgaccatgttagacttacaatttataggtgttaaacaattctaaatctgttccaagctgtgtcacataattgtactatgataccaatgcctgttttatgatattcataaaatatatttgacttacttatataaatttctctgggcatcatgtgtttggctatgcaaaggctatatttgaatcctataacttaccctgtaacattcaacggctttctctgtgttttcttccaattcataaagaagacccagaaatctgtgagctctgggatccctctcttgcacactaaggtaagtacatacgtatctgtttttcaaaagtaatacaaaagtaaattaaacttagaactgtacttttaaatgctaaccgaagaatacatcttaaaccaaagcaaccactaaactcgtttatattgttactcaaaactaccactatttatgcagataactcagaagtattcatagaaagaaatgggtaatacttaaaaacacgtacatagagttgaccacatactcgttttaccattaaatgtcacatttaccaaatttttctccagtgttatccacgcataagaaatgaacatataaattgctttttcttcctgatcacattttaataaagcactaacagttttgcaaataaattagaagtgattatagtaaacatttttaaagttatcataatgcaaaatactaaacagcaacaatttcccaaacaacaaagggaaatacacctaccctttaagcaagaaagtaatttctaacagtactatatccagctaaaatcgaacagaagacaaattactaattacagtaccaaatacaggaaatttccatttctcaaatcaagtaacaactaaaataagtaaatatcctctaggttccttgacagtattaccatcagagaaattaggccagacccaaactaagggattaaagtctcacagtaaaaaggtacaagagttaacagtcacagtgctgctagttacataatttatgtaccaccattttcctttcttaccagcatttccatcttcctttggatgcctttaaaagcctgcctcccagctgggagcagtaacacacacctgtagtcccaacagtatgggaggccgaggcaggcagactgctgtgctcagaagttcaagactagcctgggcaacatagtgacacctgtctctaccaaaaaatgcaaaccttagccaggtgtggtggtgctcatctgtatccccagctacttggggcgctgaggtgggaagatctcttgagcccagaaggcagaggttacagtgagcaaagatggagccagctgctgcactccagcctgagcaagagagacagatactgactaaaaaaaaaaaaaaaaaaaaaaaaaccctgcctccctcttaatttcctgctttaatccactcccagtcaggaaatcagaatcaccaagcttcttatccctaggatagagccttagagcatcacatattgtgtcaattaaagatcttttatacaagctattctcctgccttacaattacagttttttattcattgctattttccatctgattaaggtatcagatatctaaccaaaaacaaatgaagatataggcatggtcctcttttactccaacagaagacaatttttagaaaaagtgttttaagccaaacaatttcttgcccttggtataaagcagcagcatgcagaaaacactaattacggtttcaatctcaatggaatctaggctggtccttagcatcagtctgagtgataaatcccttattccagaatacacttaggaagaactactaagaacatatttttacctatttcaaagaagaaaatgagaaaaggcattgattttaaaaaaagaatacatgttacagtttgtacttactttttagcaagatcatattctttagcttcataatacagctttgcaaaatagaatcctctcaacttctaaaaaaaattaaaagttgttttacgtttcatacagaaatattttccaacattttttcaaaagtagtaaaaatctgccctaagtttatgttcaaatatgccattttcattcacttaaaagttttttttaaagcctgacaaatgcataattccatgttttataatttcctatcacaaaacaaaaaatagagctgggtgcagcggctcatgcctgtaatcccagcactttgggaggccgaagtgggcggatcacctgaggtcaggagtttgagaccagcctggcgttataacatggtgaaactccgtctctacaaaaatagaaaaattagccaggcatgatggcgggtgcctgtaatcccagctactcgggaggctaaggcacgagaatcagttgaacccaggaggtggaggttgcagtgagccagaggttgcagtcagctgagatcgtgccatcgcactccagcctgggcgacagagactccatctcccaaacatcatcatcatcgtcatcataaataagctgggtgcagttggtcacacctttaattctatttaattctagcactttcagagaccaaggtgggaggctagctttgaggccaagagtttgaaaccagcctgtgcaacacaacaagatcctgtctccagggggaaaaaaatagccaggcatagtggagcatgcctgtgttcctagctactcaggaggccaaggaaggagaatcacttgagcccaggaggttgacactgccgtgagttatgactgtgacactgcactccagcctgggtgacacagggagatcctgtctctaaataataaatacataacatacaaaaaataaattcaagaaagcaagacaagcagacaacagaagttaagaattttcatcagccttggaaatcttggaaaccctgtggtaccactctctcacttaacaaacaaaagaaaccagctttctttggggaggaaaggtattccagaaatctcttctcctaccatgtgtaagcctctatgggaaagaataagtaagtacttacgatctattaaggcactgaggattccctgtgccttaatagtacatgtactgttctctctacagatcagatcagtattttacagtcaaggagtcaaaaaggcagaaataaatattgaattcttcaagtaataaacaaggtccacagcctggctccttggttacgtaaactccaaagtccaaaatgctgatgcacaccaggctgggtgcggtggctcacacctgtaatcccagcactttcggagactgaggcgggtggatcacttgaagccaagagttcgagaccagcctggccaacatgcagaaacctcctttctactaaaaatacaaaaattagctgggcatggtggcacacgcctgtaatccccgctgcttgggaggctgaggcaaagaatcgcctgaacccgggaggcagcagtgggccaagaccgcaccactgcactccagcctgggcaacagaatgattccatctcaaaaaaaaaaaaaaaaaaaaaaaaagctgatacaaccagagtatgttccatccatgtgataaagagtatacagccactcaaacatcttatttttgaaattccaagaccccagtgaatgtccaaaacgatgaacagtatcaaaccaggttgccatcaatcgaaacatgtttcctgtttgtgtcctccacccacaaatttaatgtcttgtccatctcaacaaagcacttatcacacactgtggctgtaacttttgcagtttggggtgtcacaacaaaactagcacaaatttctttttccttcttcacaatttcatggacaaaagatttgttcttaccgtagatcttagcaaccccagtatacgatcttttttctttcctaagtcaaaaactcacctcttcacttaaaggaagcactatatggcttctctctggcatatgtgaactgccagcatcgctattcttgctctttggtgccattttaaataaaataagggttacttgaacacaagcaccgcaatactccaacaactgatctgataactgagatggctagtatgtaactagcgggtggggagcacatacagcatgaatatattggacaaagggatgattcgtgtcctgggtaggacggagcaggaggctgtgagatttttatcatgttattcagaactgtttgcaatttaaaactcatgaaatgtttatttatataatcttccattcaatatttttggaccacgggtgacgcaggtaagtaaaaccacgtaaggcaatactgtggataagaagggactactgtaccagcaacgaacaatcagaaaaggaaattaagaaagcaattccatttacaatcgcatctaaatgaaaaaaatgcctgggaataaatgtaaacaaggaggtgagagacttgtatgcttaaattacaaaacgttgctcaatgccaggctaacacctgcaatcccagcactggcgacagagcaagactccatctcaaaaaaaaaagaactatagcaatcttaacaaaaataatacacaacagtcaggacagcacataaaggaacaaggcttgttccccgcttcctttttttttttgagatggagtcttgctctgtcgccaggctggagtgcggtggctcgatctcagctcactgcaacctctgcgtcccgggtacaagctgggactacaggcgcacgccaccatgcccagctaatttttgtatttttagtagagatggggtttcaccatgttggccagatggtgtcgttctctcgaccttgtaatctgacttcctccgcctccgaaggtgctgggattacaggcctcagccaccgagcccggccagttcccccttttcaaaatgaagaaatagattcaaggtacaatgccaaaacataatagaaaaataattccattaccttctttgcttccaactatgttattaaagtagacaatcttaagataattaaacaactttacaaattattcttctgtatgatcttttgcctctaacctcactttacaagggaactgaagctcaagcaggcaaatgccttgtttaaagatatacagctaggaaggagcacagcccacgttatgtaaacaggacaatatctgattcaagcagtacttctttacatgacagcagatgtcactataagcaaatacctgaattcacttaagctgccaaatatcaagaactgatgcagggctgaaaacaggaacagtaagaccctaagagatgccacatcatcgctatcttgcacagtaagatagagatgtaattgtaattgtccaaaacttaacatttgtggcctactttttcattatgcagttctaaatttctctctctttttttttaattcaaacggagtctcgctctgtcgcccatcttgcacagtcaaatgaatctccctccccctaaaatcctccaaaaaagctgctgttctcaacaaacccatctgatcagctccaaatctgtggagtcccaacaagggtgaaggccgtgattatacaggacaatgaggaaaagtctagatactgaaacatgaattccccagtcttcttcccctggaacataagggtaaggaaatctctcaaaaggcagaacaaacaaaagaggagaataagagaaaaattagagaaactccagctttcaggtaaacatcattaaaaaaaagggtaagaaatggtcaaagaaataatacaagaaacgctacagaactgaaagaaatgagtttcccaattgaaaggacacttccagaaaacctttgttaccaagaacaagactctcatcagactcctaacaacagaacttctggaaaatggagcaatgctttcaaaattgcgaaaaaaattatttcaaactcagaattcgataaccaaatgatcaactaaattaagtaaagatgttttaaagacataccattagtttccagaccagcctgaacagtatggtgaaattccatctctactaaaaatagaaaaaattagccgggcatggtggcgcacacccgtaatcccgctactcgggaggctgaggcaggagaatcacttgaacccgggaggcggaggttgtggtgagctgagaccatgccactgcactccagcctgggcaacagagcaagactctgtcccaaaacaaaaacaaacaaaaaaacctctcatccacttttcctcaaagcaagtgaactatgctacaccaaaacaaagaaagtaaatgaagatgacatgagatacaagaaacaaagggtctaactcagaaaaaagatgaagggaattctcaaactggtgataaagggaagtcccaagagcacagctgtgtagcaaagaggaagaaaaaccaatctgggttggagaagtcggttagtaagggtattccaggtagacagacaatcaatcaatcaatcaatcaatcaatgttttaagctgaaattgatcggattatgtgaccagtttgaccacatttgagggtttaagttgctgagtttaagtaaccaagtagtaacacaacatacaagcaaaccaaaaaataaagcaattattcagtccaggaaaaacaaaactgcacaacaagggcaattcaaatgcaaaatatttaccttatatttatataaatgttaaatattcatttaaacaaaaactccaataacagtactgaaacaatgaggggcaaagcaaagtgtctgaggacagttttggaggagcataatagccagtacagaatgtctaaagtggggccgggcgcggtggctcacgcctgtaatcccggcactttgggaggctgaggcgggcggatcatgaggtcaggagatcgagactatcctggctaacacggtgaaaccccgtctctactaaaaatactaaaaaattagccgggtgttgtggcgggtgcccgtagtcccagctacaggctggggcaggagaatggcgtgaaccccggaggcagagtttgcagtgagccgagatcgcgacactgcactccagcctaggccatagagcgagactctgtctcaaaaaaaaaaaagaaaacaaaatgtctaaaatgggagaaagggaattcaaaataacaaaagtatatgtgtgtgttactcagaagcatgaagtatagatgtaaagggcagaaaaaaaaactaacagctgtcaaaggtgcctgcctgtagtcctaagtactcaggcaacagaggtaggaggatcatttatgcccaaaaatttgatggcagcctggacaacacagcaagaccctattctaaaaaacaaataaataaaaataagagctgtcaagtagagtttgagaagtaggaatcagctgcagaataagaaaccaacttgacagaacatagaaaaactaaacagaagccatctggaaaaagaaaaactagagaaagaattatatatttttttatttttttattttttggagacagagtctcgctctgtcacacaggctggagtgcagtggcgcaatctctgctcaccacaacctctgcctccagggttcaagcaattctcctgtctcagcctaccgagtaggtgggactacaggcgctgccaccacgcccggctcatttttgtatttttaatagagacggattttcaccatgttggtcaggctggtctctctgcctcccaaagtgctcggattacagacgaagaatatttttaagaagggcaaaagcacatgtgagggagtagaaaaatggcaaaacaagagaagattaacaaatgaaagcacaatggaagactagaaagatatgatatacagacgcatcatcacactccaaaactcagacattctagaaagcatgggcagttcacagatggccagcctctgccaaactgggggagaatactaacctctttatattcttcacagccactgcctcttctccctccattccttaccttctatccaaagcaccctgttttgtcatttcactcaaacctaactttacagaatagcttcacatgttccaaagttactcactagttaatccatattccgttgaaatccccaggttctaatgtaaatgactttaaatttgggggaaaaaaaaagactctaagtgtaagagaggtgaggccgaggccgaggccgccgccgccgcccggccaggccgaggccgccgccgccgccgccgccgccgcccggccaggccgaggccgaggccgaggccgccgccgccgccgcccggccaggccgaggccgccgccgccgccgcccggccaggccgaggccgaggccgccgccgccgccgccgccgccgcacattaaccttttaagttaaagattaagagaaccaacacctctttacagtgaaatgccccaactaaatactaccgtatggcccaccataattgcccccatacttcttacactattcctcatcactcagctaaaaatattaaatacaaattaccatctacccccctcaccaaagcccataaaaataaaaaactatagtaaaccctgagaaccaaagtgaacgaaaatctgttcgcttcattcattgcccccacaatcctaggtctgcccgccgcagtactgatcattctatttccccctctattgatccccacctccaaatacctcatcaacaaccgactaattaccacccaacaatgactaatccaactaacctcaaaacaaatgatagccatacacaacactaaagggcgaacctgatctcttatactagtatccttaatcatttttattgccacaactaatcttctcgggctcctacgccgaggccgccgccgccgccgccgccgcccggccaggccgaggccgaggccgccgccgccgccgccgccgccgcccggccaggccgaggccgaggccgaggccgccgtcgccgccgccgccgcccggccgaggccgaggccgaggccgccgcccggccgaggccgaggccgaggccgccgcccggccaggtcgaggccgccgcccggccaggtcgaggccgccgcccggccaggtcgaggccgccgcccggccaggtcgaggccgtcggtctcttcgagatccactcacctttccaggcgacggggcggagccctgcaccgaggcgaggtaccgctccccgtaggctttgctgcgcctcatcgcaccgccaacctggctcccgagacgcgtgaaaccagcgctcagccccgcagcagtcgccaattccaacaggaaagcgcctgaaagccactgacgtagccggcggaggaccactgtgacgcacttgtgtactgcgtcagcactgtgtatccttggcgacgtcggcgctcgagctgcactcggccgggctcttggcagcaccctgtgctctgagggtgtcttgcccgccgggcgccgtggctcacgcctgtaatcccaacactttgggaggccgaggcgggtgctgtaaaccattcatttgcttatttcaatattttcatttgtatgctttcagataagctgaacttgttccaatctgctatacataggtttgtttatatctttacagtaaatatctcagttaagaattattttctctttgtaaagacattgtgactcagatactacttgtaaagtctataggaacacacagctagtaaatggcataattgaaattcaaatggaaatctgattctaaaatatacttgtagcaacatagctgattcctgttactgtatctgctcctgtaaattttgtaaattcattacaatttttaaaatataaaatattttcatatatttatttagtctttgctaccatgaatagcttcaatgggaatgatgattaattctagaatgtgcttgtcttttacatttctatgatttttagggttaaaataaaccttgttggtttacaaatgattcctgaatgatttctttcctctaaatgctacagcacttcactacaaggtctgcaaagaagctatgtgggggagtgaagtaggaggtgactgagattatgtaattaagttcatatatgtcataatttttcattgttcccactgttttagagaaaagtaacaaaggagaagacatgtgggcgtgtagagaaatgcaaggtggagatattaatgctacagtataatcttctgtgggtgtttagcctggggatgagaaaactaaggagaaccatgccagttgtgttgaaatatttgaagagctgtcatgcagaagagagaatagacttttttctgtaggcccagagggtataactaacattaagggaagaaagtcatagggtagaaaaattttattcaatttaaggaataactttctaatagtgcatagtattggaacaggtggctgcataaagtcccacgaagtgttcattctaatgctgaatacccatgcaccaagaatcctgtggaaatgatgcttgcagggattaaagaatgaagtagaatctaatctaatatagcctcttcctactagaatgccaaactcagaaagactttctctctgttctctctttctctctctctcgtgctctctttgtctaatttatctgtatacctatttaatttccaaaaaatgagattgacaggaagtgtaagagttaaaaagaataatgtgtgtatgcgtgtgcatgtgtgtgtgaaaaaatggattttaaaggtattggatgcccgttgagaatgtttatattcctctaccccttgaggtttatggttagcaaaaaaatagtaacaaagataattttgttatatcttattgtatggcagaaggagatttccatagtagaataaaaaaaacttttaaatcagagataacctgggttcaaattccaactttctcactttcagctttttgaccttgaaaaagtaactgaacctttataaaccttcatttttttactataaaatttggataataaagtaccttaactgtagggttactgagaaattaaatgagacaagtcacatgaagcacactttatattgcctagtatgtagacagcaataataaatcctggcttcatatatttccttactttagtttacattgtttttacaaacgtatcacatcagctgatagaattttgatgtcgtcatttaagtttctggttatctggtgtagaatgcaactgtttttctgatttaagataattcaatcaacaaatttttcttgagctccaattttgctcattctacctttctctccatgcaaaaagaaagtgagaaatgtcatttcatttggcaatggttaaacataggcaaacctttagaaatatttctttattttaaaatttgtgcttgtaaaatacttagttataatatatgtttactaatttactgttttttaaagttgttttattacggaaaaacaattttggtgctatacaccccagagaatactttaatgctcaattatctgaaaaaataatctatggtatgctttttcacagccctgctgaattctaggtactcttcctcgaatttgtgtgagaaaatatgtagactcacagtttacttcagaattaaaaatattactacagaatacattcaaattttatacctctgattgcagcatattgaaatgcttaagaagttccattagtgcagatgatgacaactatgtatgcaaaagtaccagagaaattttatgtgtgtttttatgcatgtatctttgtgtatggttacagtatgatcgtggcaaatgtataagatacacacatgttacacttttcatgcctgattaattcataaaaggcatgtgtgtgagtgtatgtatgtgtgtatttgcttatgctcactttctgtgcttgtctaaataatgaagatttttttcctgtatctatgctttcagaaaccatacctgactaactggtggggaatgtgtatttacattttgccactacactaattatttctgattaaattttctagttgcttacgtaaatcatgaattggattctcgtgttaatttgactaaaactaccaactagtaaatattttcaattaagtgattttcttcataattcccatcaatgattctttgttcttgttttttaaagaatattttgattaaaatacaatagtgtcattgtaaaatgattgacaagtataatgaatgaaataaaaatagttgaagatttttaaaccaaaacaaattcagtgataaatgttaatatattttattctagttgtttgtatgtctgtatgtagcagataaaagaaaatctccatgggaattgagatgcaaatgagattgagacatcattaggataaaaatgttagaatcatgaatgtcagaaaaaaaattagtacctggtaaacttgaggaaatctttgtactttccaaagataaaaagaaagttgttgcaaatcaatttatttttattccgaaaagacaaagtgatccagctgatatacagttatagataaatgcatgtacagtcatacagtgtatatcctgatgctttatataatatgtgacagcaagcttgtctttcttctttaataattgttgaaaatttaatttttgtgaccacatggtaattgattacaagaagggactatagtgtgtttatttattcatttcttgaacatttccattgctttctactttaaaattgctttaacagtgctgcagtgaagatacatgtactcaaatattttttaataattctactaattttcattaattatattcctggaaatgcatgtagaaaattaaatgatatagatattttaaatattcttattaccatattacttgattatttttgccacattactttctagaacagttgtgtcaatctgttttcttgttgggaaggtaaaatgcaaacattagatgtctagaacccaataaaaaagacaatgtaaacaagttgtattagtttgttctcacaccattatgaagaaatacctgagacacagtaatttaaaaaaacaaaaaaacagaagtttaatggactcacagttccacatggctggggaggcctcaaaatcacagtggaagggaaaagaggagcaaaggcaagtcttagaaggcagcaggcaagagagtatgtgcagaggaacggccctttataaaaccttcaggtctcatgagacttattcactattgtaagaacagcaagagaaaaaaaacccgctcccatgattcagttgagtcctgtcaggtccatcccatggcatgtagggattatgggaactaaaattcaagatgatatttggttgaggacacagccaaatcatatcattctgcccctcaccccttcctttcaaatctcattttctcacatttcaaaacacaatcatgccttcccaacagtcccccaaaatcttaactgctttcagcattaactcagaagtccacagtccaatgtgtcatctgagaaaaggcaagtctcttcggcctgcaagcctgtaaaatcgaaagcaagctggttacttcctagatacacgggggtgaaggcattgggtaaatacacccaaatgggaaaaaatggcaaaacgaacaggctacaggccacataaaagtccaaaattcagtgaggctgttaaatattaaagctccaaaatgacctcctttgactgaaggtcccacatccaggtcacactgatgcaagaggtaggctcccacagccttgggcagctctgcccctgagactttgcagggtacaggctctctcctgggtactttcacagcattttccacccctgctgaaaacttctgcctggacatccaggcatttccatacatcctctgaaatctatctagagattcccagcaagatcaccatctacatctgagaccacctcagcctggattttattgttcatttcactatcagcattttggtcaaagccatccaacaagtctctaggaagctctaaactttctcacatttttctgtcttcttctgaaccctccaaactctttcaacctctgcctgttacccagttccaaagttgcttccacatttttcagtatcttaatagcagtaccccactctactgataccaattgactgtattagctcattctcatactgctatgaagaaataacaagactgggtaatttataaagaaaaaggtttaaaggactcacagattcacatggctggggaggcctcacaatcatgtcagaaggcaaaggaggaagaaaggcatgttttacatggtggaaagcaagagagcatgtgcaggggaactgccctttataaaaccatcatatctcatgaaacagtcactatcacgagaacagcactggaaaaacccacccccatgattcaattacttcctgcttggtgtctcccatgataaatggggattatgggagttacagttgaagatgagaattggagtgggacaccgtcaaaccatatcacaaatagtagaaaaagacctacagcacattaacatagttgcgttaccacacaggctttaaaattaaagttatttttgcatgaaataaaacacgagaaatatgtttttgcatgaaacaatgaaaatagtcaataaaataatggaaagtatggtaacttaaataattggattcatgagaaataaccaaataaatattctagagattaaaaatgcagtgtctcaaacttaggccatataaaatatgtttaacagcaaacaggacatggcagaagacaaattagtaaaatggaaaagatatcaatggaaaatagtcaatatgaagcacagggcaataatgatttttttttactggacacagtgtaaggaaaatgtgagcacattaaaatatctaacatatatgttgttagaggtacagaaagagaagagagagaaaatagagcagatgtaatatttgaatatgtaataccaaaaattgatagacttcaattgacaaattcaagaatatgagtgaaccccaaccaaaataaaaacaaagagaaccccatgtatatgcttagtcaaattactgtaagctgaagtcaaagtgaaaaaacatatcttaaaaaaatagctgtgatttgggaagagacatacaatgttactttcaaatcagccacagtaatactaacaactagattattttccataagaaatggagccagaagacaatagaaagttattattaaaatactaagtaaaacaaaatcctaataaagagaaagacctaccaacctatgatagtatccctaataaaaatatcactcaaactgaaagctaaataaatcattttcaaacaaaagattgatgagataattcatcagcagaactgctaagtgaatttctcaagctgaaatcaatgatgataccacatgagaagcagaatcacagtaaaaaaaaaatgaagagtattagaagctttaatatataaataattataaaataatattttaataatattgttaacacagaaacaacaaaatcttggtagatttataataaatatgtatataaatatatgacaaatatcacaaaaggcatggaaatggtgcgaatagttatatatgctttgtaaaatttgtgcagttttataaaaatattagtactactaaaaaatggttgattataataactaggaatgcattctgtaacctaaagatgttaataaaaattaataaaagaatgtacaagtaaaacttaatataatagaactaattgtataagaatgatgattaattgaaaataaataaatttaccaaaaacaaagaagaaataatgaaacaagttgcaaaatggttgacttgaacctacctatgttagtaattgttttaaatgtacatgtactaaacactctaattgaaaagcaaactgtcggaacaattagaaaatacaactagatgctgtttaaaaaggacaaatattaactacaacaacacagaaagtctggaagagaaaggacagaaaagatataccacacaatctctaaataaagttactgtaggtaaatataaactatatcaaaatatcagaccatgttgaaagtaacaacttttattctttggaccataaacccacacacagaagaagattattaaaatatgcatttaacaaaagattttatttagaatagataaagaaatcctggaagtcattaaaaacaagataggcaattaaatttaaaactaaatggtaggctggatacagtggctcagtcttgtaaacccagcactttgggaggctgcggtgagagaattgcttgagtctagaagtttgagaccatcctgggcaacatagcgagaacctttctttaaaaaaaaaataaaaattagccaggcttggtggtgtgtactccagaggctgaagtgggaggattactttatcccaggaattcaagactgcagtaaactacgatcatgccactgtactctagactgggtgacagagagtctagtctctgtctataaataaataaataaataaatataacatagtaaaagaacctgaacaagactttcagaaaatgatatgtacatgaccaataagcacataggataatgatcaacgcaactagtcattaatcgaatgaaaatagaatcacaatgagacactactacagacctactgatgactaaaattaaaaagacaaataataccaaatgttgacaaggatgtaaaggaactgacaatcccatattttgccagtggaaatataaattgctgtcagtttttcagaaataattttggctgtttctactatatctaagaatacatacatctggtgagccagcaatttcactccaagagaaatgagttcttaccttcaccatgacatgagcaagaatattcataacagttttatacattatagccataaacataaactgccagttaaacgaggagtttgaggagattttggttgaaaagtacaaagatttagttagaatgatgaataagttccagagcactattgtacagcatggtgactgtagttaatagttaacataatgtatactttaaaattgtttatagagtagatcttacctgccttcaacaccaaaaaataataagtacgtatggtgatggatatgtttattagcttgatcccgtcattcctcactttatacatatataaaaatatcatatatgcttcaaatatatatatagttttttgttaattatagcatagtgaagctgaaacaagataaaataaaatgtgggggagttttaccatatggagaagctggtaatagcacaataacaataataataacagtaataattgttatataacccaaatatttcaaagaatgaatgatagttaaaagctacatatcttatattacaattttagttatactatttatctaaagaagccaaagcttaaatataattaattgatattttaaaaagtaaatacttttatcgggaaatgcagaaaagagagcactttccagctttcagtagaaagccagcattgtcctgacatcaaaatctgatacgtaaattataatagaaaactacagaaaaatgtctgtcatgaatatagatgcaaaaaaatttataaaacattaggatacaaaatccatcaatttataaaatgtatactacatcataaccaagtggattttttacctggaatttaatattggtttaatatttgaaaatcaatcagcgtgattcaccatgaacagagaagcggagaaaaatcagaaaattagaagtgcatttcctttatctgataaataacatctaagaaaaccttcaatttatatcatatttattggtgaaaaactgagctctaaaccggggaagaagaaaaaggtatctgtgcacaccatttgaagtcaaaattgtaatgaaagccataacaagtaagacaaggttgaaaaaatatgcaaggcctcagcctgagaagcaagaattaaagctctccttatatgaagattacatgatcatagatgtagaatatagtaaaaaatgcacagaaaatctactagtgctagcaaatgacttttgcacatattcaggatacagtgtgaatatatagaaaaaatagattttttgcttactagtaacaaacaattggaaagatttaaaatatcactcaaactaacacaatatgaaacaattggatatgaatttaacaaaatacatgcaaaaattatacactgtaacacataaacattgctgagaaaaagttaaaaagccataaatgagtggggaaagatattgtattcatgaatttgaagttccaatattgttaagatgcccatattcataaaatgttacatagatttattgtaatctcacacgaacatgaggatttttaaaaaaatggttaagtggatttgaaacttataagaagcaaaagacctataatgcagaaaaacaattttgaaaaagaagcccaacgttgtaatactaacattagcaaattgaagactcaatatataactgctgtatatgatcaattgattttctgactaaggtgctaaggtaactaagtatggaattaataatatgtcaacaaatagttctgagaaaaacaggacatctgtagataaaaaaatacatatttacatttatctcactccatatacaaaaatgaactggaaatgcatcatagatctaaatataacaaccaaaattaaaagcttttagaaaaaattgtaggaagatgttgctgactttgaggtaggcaaagggttcttagacatataagaacaaattctagtcatagaagaaaaatgatctgatacagctgaaaacgtcactataagaattttataatacaatcagaaatatcaacaagagaaaggaataagcagaggaaagaatctcagtgttcaaaaaaatccgttctttgaatcaactcagtcagacaattataaagaaaaaagaataaaaagaatgattaaaacctctgaaaaatatgggattacgtagacaccaaacctatgactcattggtcattgtgttgtgggaattgagggactagagagaccaatgtgtggaacaggagaattttatttaggtgaccactggctcagtgaactaacatccacaggctgagccctgaacaaagacagggctccacttttatacatgcatctgaaaagggtgtgaaatctgtaaggcgggtaagcaagcttacagaagcagaacaaaggcagtttatcaaccagtgacaggttttacaactcaagccaggtgttgcaactcaggcatatcttgtgaccttcgttgtgctgcacagaagggaaaaacaggaacttacaaaacttgcaaagataattgtgagaatagtaagggggaaagtggaagctgaaagagaaaaacttgtttttcccaaccttgctctgggtttggagggagagactctggagcccattccttcttagccttggctctgcagatagtgctatcaaagcctccacagagccctgcccttccctgggtcttggagtgagtgagcctagtacagaaaaacttgtttttctttttatatcttctgcttcaattggtgtccttgaaagaaagtgagagagagcaaacaacttggaaaacatatttaaggatattgtacacaagattttcatcaacattactatagaggtcaacattcatatccaggaaactcagataacccctgtgagataccatacaggatgaccattcccaagacacatagtccttgatcctccaaggtcaaagaaaaagaaaaaatattagtgggaactagagagaagagacagacaaatagagaaagaaagaaggaaggaaggaagaaagaagaaagaaaggaaagaaagaaagagaaagaaaaagagagagagggaggacggaaggaaggaaggaaggaaaaaaaagaaaagaaaagaaaggaaaacagaaacaaaatatcaggccaacaatggaccattcagcagaaaccctacaagccagaagagactggggacctatattcagcattgttaaagaaaagaaatttcaaccaagaatttaatatctagccaaactacacttcataagtgaaggaaacattaaatatttattagaccaagaaaatgctgagagaatttgttaccaccagagctgccatataagagttccttaagggagtactaaatttggaaacaaaaggccctaaccagctattgcaagaatcattgacaatgtaaatgaacaacacaatcaagtcatcataacaactagcttacaacacaataacagaattaaatccacaggtatcaatattaacatccaatgaaaatggctacatgctccacctaaaaagcacagagtgacaaattgggtaaagcagccaaacataactgtatactgccttcaaaatagccatctgacatgcaatgacacccataagctcaaagtaaagaggtagataataacttatcatcaaacagaaagaaaaatgagcaagggctgctattcttatttcagacaaaacagactttaaaccaacaatcatcaaaaaggacagagaagagcgttacataatgataaaagtttcaattcaaaaatatgtgactattctatctatatatggacccaatacaggagcccccagattcatcaaacaagttcttagagacacacaaatagacagataaccacacggtaaaactgggagacttcaacattccagtaaaggaattagacaaatcatcaaagcagaaaactaacaaagacattcaggacccaaatttgatacttaactaaatagacctaacctctaccaaaccttccacccaacaacaacagaatatacattattctcatctgcacatggcacataccctgaaattgaccacacagtcataaagcaattctcgacaaattcataaaaactgatatcacaccaaccacactctcagaccacagtgcaatataaatagaaatcaatatcaataagatttctgaaaattataaaattacattaaaattaaacaacctgctgctgaattactttgggtaaagaataaaattaaggcagaaatcaagaaattctttgaaactagtgaaaacaaagatacaacgtaccggaatctctggggtgtagcaaaaatagtgttaagaggacagattatgacactaaatgtctacatcaaaaagttagaaagatctaaaattaacaacctaacatgacacctagaagaactagaaaaataagaggcaaccaacacccaatctgccagaagaaaagaaataaccaaaatcagagttgatctgaaggaaattaagaagggaaaaataatgcaaaagatgcaaaaaaccaaaacttggtttcttgaaagaataaataagtttgatacacttctagttagaataatgggaaaaataagaagatttaaatagaaacattcaaaaatgagaagaacacattactactgactatacagaaatacaaaaaaccctcagggacaattacaatcacatctatgcacacaaattagaaaacctagaagaattaaataaattcctggaaacacaaaacctcccaagatttaaccaaatgtaaattaaaaccataaacacacctctaaggagttctaaaattgaatcactaataaaaagctgatcaaccagaagaagcacaagaccagttgaattcacagtcaagtagtactaccagacatataaagaagagctggtattaattctactgaaactgttccaaaaagttgaagaggaggcactcctccctatctcatcccataaagcccacatcattctgatacccacaccagtcaaacacactgcaaaaaaggaaactttaggtcaactttcccaataaacttagatgtaaaattcttcaacacaatacaaacaaagttaatccagcaacacatcaaaaagctaatccaccatgatcaagtaggcatcattcctgggatgcaaagttgggtcaatatatgcaaatcaataaatgtgatgcatcacataaacagaactaaaaccaaaaaccacgtgattatagatgtagaaaagactttcaataaaactgaacttcctttgtgttaaaaacccttgacaaactaggcatcaaaggaagatagcacaaaatactaacagccatctatgacaaacccattgccaacataatactgtacaggtaaaagctagaagcattccctttgagaaccagaattaaacaaggatacccacttttacaactcctattgaacaaagtattggacatcttaggcccattctatttccgcagaagaataatgagatgttcaacaaagctgacgataagaagcaatgggaaaaggattctctattcactaaatggtgctgtgataactggctaaccatatgcagaggattgatactgaattacttcatttccccatatcccaaaatcaactcaagatggattatagacttaaatgtaaaacccaaaactataaaaaccctagaagaaaacctatgaaataccattctggacataggtcctggcaaaggtttcataaaaaaaaatccaaaagctactgcaacaaaaataaaaattgacaagtgaacctaatgaaactaaagagcttctgcacagtaaaagaaaccgtcaacagaaaaaacagacaatctacagaatgacggaaaatatttgcaaactatgcatccaacaaaggtctaatgttcagaatctataagacacttgaacaaattaacaggcaaaaaacaaacaaccccatttaaaaaatgggcaaaggccatgaacagacacttctcaaaagaagacatatatgtggctaacaagcatatgaaaaatgctcaatatcactaatcataagagaaatgcaaatcaaaaccacaatgagataccatctaataacagtcagaatggctattatcaaaaagtcaaaaaataacagattctggtgatgttatagagaaaaccatttgacccagcaatcctattcctgggtatatacccaatggaatataaatagttctaacgtaaagacacatgcactcatatgttcttcacagcactattcacaatgggaaatcaacatagatgcccatcagtggaggactggataaagagaatatggtacatgtacaccatgggatactatgcagccataataaagaagaaaattgtgtcttttgcagcaacatggatggagctggaggccattatcctaaatgaattaatgcagaaaaagaaaccaaataccacatattctcacttataggtagaagttacacaatgagtacacgggaacacaaaacatggaacagtaaataccacagcctacttgaaggtggagggtatgaggagggtgaggattgaaaatccacctactgggtactaggattattatccagatgataaaatgatctatacaccaaaccttcacaggtactcccaaacctaaaataaatgttggaaagaaaaaaaaaacacattattcctcaagagtgtttacacaaatagcacacttactgtaaaagccagaaaatggaaataactgaccaatgaagaaataaattgtggttcatccatatggtgtgtactgaatttaagagtatccccttcaaagttatgtccacccagaaggtgtgaataggatcttatttggatataggatctctgcgtatgtagtcaagttaagatgtggtcatgaaggattagggtaaattctaatccagtgactggtgtccctataagaagagggaaacttcgacaccaatatactcagaggaaaatggctatgtaaagacagaggctgagattagatttatgctgccacaacctgaagaagagcaaggattgatggtaactcccagaggctagaagaggcaagaaagaatattttgatagagcttttggaggcaatatggacttgccatactcattgattttgaacttttattctccaagaactttgagatgataaaattctgttatttttagctgcacagtttgtggtaatttgttatggcagccttagaaagtagtacatagaggatgttacccagaaaaaacataaatgaacccttgatatacaaaacatggatgtattttaaaaaaaaaatttaaaaagaagttgaaatgaaaaatgcatgtagtatgatgtcctttatatacagttttagaaaggtaaaactgttaataagataaaggagaccagtattttcctttgttcagatgtgtgaggaattcactgcaaagagcatgaggtagttttatgagaaaaaaagaaatactcaatatctttttctatatagttattgatgtatatacatttgtcaatataaatcaaattgtacacttaaaatgactgcattttatgctatacaaatcatagctcagtaaagtttattttaaacagaaaagaaatatatgcattgtagaaaacttaaaaatatatttaaaatgatgtttatataattgtattagaaggaaatcactgttaaattttgacacaatcatgttctatcctaactttctcacttgtcacatcaatttcccaaatcaacaagacactttaataggactataactttctaatctgtatgacagttgatatagtttgggtgtcttctctaaatctcatgttgagatgtaatcctcagtattggtgttggggcctggtgagaggtgtgtggatcatgggagcacatccctcatgaatggcctaccaacatttccttggtgatgagtgagtttacacaagatctagttgtttaaaagtatgtggtacatccccccttctctcttgctcctgctctggccttgtgacatccctcctcccgcttcacctttcaccatgagtgaaagctcccttgaggccgactctgaagctgagcagttgctattaatagcaccatgcttgtacaacctgcagaaccctgagtcaattaaacctgttttccttataaattacccagtttcagatattcctttatagcaatgtgagaaaaacctaacaccacagtctcatattacaattatataatttctttaaattttaaatataggtttggtaagctattgattattgccacaatttcagagcctgttattggtctattcagagagtcaacttcttgctggtttagtcttgggagggtgtatccatgaccagatggattcacagtcgaattctaccagaggtacaagaaggaactggtaccattccttctgaaactattccaatcaatagaaaaagagggaatcctccctaactcattttatgaggccagcatcatcctgataccaaagccgggcagagacacaacaaaaaaagagaatttagaccaatatccttgatgaatattgatgcaaaaatcctcaataaaatactggcaaactgaatccagcagcacatcaaaaagcttatccaccatgatcaagtaggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccaatatcatactgaatgggccaaaactggaagcattccctttgaaaactggcacaagacagggatgccctctctcaccactcttattcaacatagtgttggaagttgtggccagggcaattaggcaggagaaggaaataaagggtattcaattaggaaaataggaagtcaaattgtccctgtttgcagatgacatgactgtatatctagaaaaccacatcgtctcagcccaaaatctccgtaagctgataagcaacttcagcaaagtctcaggatacaaaatcaatgtataaaaatcgcaagcattcttatacaccaataacagataaacagagagccaaatcatgagtgaactcccattcacaattgcttcaaaggcaataaaatacctaggaatctaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatgtatagattcaatgccatccccatcaagctaccaatgactttcttcacagaattggaaaaaactactttaaagttcatatggaaccaaaaaagagcccgcatcgccaagttaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctcatcttggacaaacctgagaaaaacaagcaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacagtgaactcaaacaaatttacaagaaaaaaacaaacaaccccatcaaaaagtgagcgaaggacatgaacagacacttctcaaaagaagacatttatgcagccaaaaaacacatgaaaaaatgctcaccatcactagccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaacccttgtggaagtcagtgtggcaattcctcaggaatctagaactagaaataccatttaacccagccatcccattactgggtatatacccaaaggactataaaacatgctgctataaagacacatgcagacgtatgtttattgtggcactattcacaatagcaaagacttggaaccaacccaaatgtccaacaatgatagactggattaagaaaaggtggaacatatacaccatggaatactatgcagccataaaaaatgatgagttcatgtcctttgtagggacatggatgaaattggaaatcatcattctcagtaaactgttgcaagaacaaaaaaccaaacaccgcatattctcactcataggtgggaattgaacaatgagaacacatggacacaggaaggggaacatcacactctggggactgttgtggggtgtggggagggcggagcgatagctttaggagatatacctaatgctaaatgacgagttaatgggtgcagcacaccagcatggcacatggatacatatgtaactaacctgcacattgtgcacatgtaccctaaaacttaaagtataataataataaaataaaaaaataaaattttaaatataggtttttaatagtttttgctttaaattattcaattcaattttacttattctgatacacggtttcagaataaaaataattattaatagtgttttgcagttatgatatttttaattttataattatttaaaagtaccttttcttatctatttacacatattcttgattgtttagatattataatgtagtcaaggactcggtacatctaggctgatagcaaaacattcactcttgttctgatttgcctattatatatttcagtgatgattcatgaaggttttcttgtttttactttttaaaataatttcacgtaattttaggtgacagaataatttttatgtttcgaaattaataaaggtgaattaatgtcatgtggagatacattatatatatatattcaagtgaattcgtccagaaagatggaattttaaatttccatttcttaagtctctcagtaatttctaaaatttcttaagatattatctatgttatttgtattaattttttattttattttacaatttcattgtttcttcaaatatatatttctattatattttctaacctgtaatatctcatttataaggaaattattgattttgtatatttagtttataatcatccagtttacttctattacttgcagtattttgtagttgcctcttttgcattttctatttttctaatcatagcaccttaaaataacgattattttgtcatcaattttcaaataggtaaattactgattcttttcttattgtctgagcaatacactcagactagtattaaataatcctgatgacagtgcatattatttcttgtcttttattccaatgaaaataatgttggctcttaggttatggtaaacttgcactgtggctaagagtatgtcctatggagaaattctgcatttcctagttgaactttcagtgactcaaactcctgagcctttttcttcatttgaaataaagaagctgatagtgccttatcttatagagttattgtaaggattaaatgaggtaacaaatgtaaaatgtttactacggtggccaacatattctaagggctcaatgttagtaacatcaggtatgaatgctaaattaaatgtctttctgtggacatttcttctgtggagctatttttttctcattctatttatgttatagataaaatatgatttagtatagtaacatattcataaaagaaaatataaagctattttttcattgatgaaacaataatttcctcaccacagaatagcatcattttatacacaaatgagtttgatttgctagggggggtttgttgaaaatatattttaaattagcatgtgcatgatcaggctgtacaactttgtgttattatctataaggtcatggtattagttttaaactagcttagcaaaatataaatcttagttatttttataagtgacagaagagtttatacagcatattaattatccgatcttgaaattttaaataaattctctgtaaaaccaaatgaaactagtgctatatttttagtaatgctttattaccttttttaatattttccattgtcattgtttctttcaagacttttgctttaagataattttattttgcatagaaacttatactttaaattagaaattatacttattagcatattttattgacagtattatcttataattttaaaatatctttattgtgattttattttcttaatgattaaaatttgatttatgttcgagttctcttcttgattacaatttcaaaatacttttcttatcattcattttttcttatacattttataaacagtacattatattgtgcatagtgttttgtatactgcttttgatcaattaagttctttaaacaccattaattttacttgtatatcataattttcctatatgtggtgtttttttggggtaatagcctcattggtatataattcacataccatacaattcacttatttaaggagtacaattcaatggcttttaggatgtatacgaaggtaagaaaccattaatacaaccaatttcaggagattttcattactcttaaataaacatccacactcattatttcaatgcttgcataccattgaattatgcaggcacagtgtggttactaaaatattctcaattattgaacaattagattatttatacattatgatattgttcccaatacatagacatgataaatattggatgtgatgtgaaccccaaatacattgacttgatcattacacattctatgttggtaaaaaatatcacatgcatcctataaatatgtataaatatttctcaacaattttttgaattaaatattctgatgaacattcctgcagccaaactttgtgtaagaacgctatgagcatacgtgcaaaaactaccagatatataccaaaagccttaaacatctggtaacttttcatggagaaataccttccttctagatcattcaaccatggctattagcattttttaaatggtaaacattagaaaagtcatgttatatttgtatattattttgccttccttcaggtgataccaagtggaatattttttatattttgattagctgttgtggtttattttctgcctcagaagtatattaaaagttttttgtttttgtccttttcagtttttgaaaataaccatgtcttttgtaactgttttgtatcttatttcagttgctgctctgtcttctttttttaattaaggcaatattagccttatttttccgtgtttttaatgacaatgcagttgtgtttttacttttttagaaatgatattcctagtttcttaggaacttgtttttcatcaacagtggtaattcatcaaattggtaatgaaatttatcaactgaatttttagtatctttccagattaccattgattttacttgatgatatatgttattacatttattgatgttaagccactttgcatgttaagcgtaaaacctttttctaaccaacttatatttggatgacataccattgtgttttattttctagaattctcatatctatattcaaatctcattgcagtttttgtgttatatttctgttttttaatatacaggtatttcttgcttggcaaagtgattagcatgttttgatattttttctattgtaggagagtttggtttagaattcataatttcttgaaagtatggagatatttcagtgtaaagttgtctggcttttcagattattttgagctaagtatttgacataattgttttttaattttttttttttttttttgagacgaagtctcactctgtcaccaggctggagtgcagtggcgcaatctcgactcactgtaacctccgcgtccagggttcaagtgattctcctgcctcagcctcccgagtagctgggaccacaggtgcatgccatcacgcccagctaatttttgtatttttagtagagacaggatttcaccctgttggccaggatggtctcgatctcttgatcttgtgatccgactgcctcaacctcccaaaatgctgagattacaggtgtgagccaccgcgcccggtcctatctgagataattttgattttaattttaattcttttgaacttctattttagataggagggtatatgtacacgctcattacatggttgcattgcacccagatagtgagcatggtatccaacaggtagtttttcgacccatgacgtcttcctcttccctctaaaagtccacagtgtctattgttcccatgtcataatttttatttttttcataagtataggttgattcacagtttagaagttttctattttttgttttgacatcctgtggtttcctagaaaataagtcatattttctagatttccaaattcattagcaaggagtaatacatattttctcatacaatcaatagttattaatacagcttcttgctattcctgatttatttgtattttattatacattatccattaagcatgacagaggttgctgtagtttgtcttttgaaccaatttatagctttaaaaataaattaaaatatattactattgtacaaattgttaattcatagtttcattatttttatttacttaaaagtacagattattttcattatttctcagtaaaaaatgtagtgatgctacatgatgaatttaattttggcagtttcggctgtagtccatgttttagtgaaaatctttgttttataatcctcttgatatatatttagaatcagtttggaatgaacatatgactgattgagaaatgaattctggaggaatgaaaccaaagaatacacgttattcagtatcatatatattttcatttgtggttaattggtacgattccaataacttcagagctagagaatgtaaaaataatattgcagtgttacacaatcaaattgagatggcatgaggattaaaatctttatgataaaaacacaaacacagaaacaactctggcttcatttttatgtcatgtgtcttaacctggggtttaataacctaaaaaataaatctggataccacatcaaagggctttcaacgagctctacaaaatgacatcctggccaaaattagaggttttggtttaaaaagggtggaaaataattgagggtgtggtgtgtgtgtgtgtgtgtgtgtgtgtgcaaatagataaatataagccctttcttttattttggtatcaatgctagtcctaggatactttctcagagacctatgacaaagtaactttggaagtttaatcatttcttacaaattattttttcagaaaattgacgtttgagttacaaaaaaacattaaacattgctctagtaacagcatgtatattgtcttcacaaaatatttaatgccaaaacgataatttatggagagaaaaattgtattttcttccaagcatgtgtagtgagtgtttcaaaggtaatcatgaagcataagataaactaagaaaaatgcatatactgataatgtatttatataggaaataaataatgataatacaaatttacaaagctgagaaaattaagggaatgaattgtgtctgtttttatttgaaaagactattatagttagttgagatgtaagggttgaaatatgattgctatgattcttatacttatcagaataattttacagatgacatagcatacaattactagtataattactactcactccaggaaataattgaagtcatttattaattttgagattttttttccttttttccaaaacattatcataagagtttttccatctttatatggacaagtgtattcagatttttctcgtttttcagataggaataatatgtgctaggcacacaactgataacaacaacaaaaaaataaaaacatgacaacaggactagagtatatctacccatgtgtacaaatgtgcctgtgatatgaagggtgaagtatttgccaaccaaatggtaacttgccttctaaactagattcctttcaaatccaatacttcccctttatactgacatgttggttacctacattcagaggaatattgtatatagtcatacaactagtattagtcagtcagcatgctaattataatacaatcatctatgtggtgaaaactgctgatgtaacatattcagctctgtccacgtggggctttcatgcttttgggtttgatgttccctacatctaaaatgtcctggaatcgacaaactagccttagaataatttctcatctttcaaatctgactttacgtgccgtttcacctgtgaagaatttaaattttttggccaatcttaatttgccaaagaaaattgactatgctctctccttagtcttcaactgtgccctggcatggctaaaacttaattgaacgtacttatttttgtaatgataaatcctttgaagtcaaatgccatgttcacttgtttcgattcaacattcccaacacattatctcaaatattatttattgattgaataaacgattaaatgaataaatgtattaatgaatgaatagaaatcaacaagtcaattaagttaataagctggtcagatttgtcacttacacctcaaccacctcaaagaaattggctattaccttcaaaagatgaaatatgagcttctttggaagttacacgagaaaacagcatacttggttgttttcttaggaatgtgtcacaatcatttcattatgacaccaacaacatcaaattgggctctcaatttgcatttaagggattgacaaaactaggtgtattacaaagcttcgcatgttggctgagttgtaaggactcaaaaacaataaatgggttcctaacatgaatttaccgtaagacccagaaacttctcctctttggttaataaccaaacaaagcaaaatgaggtattcaaactaatccctctacatgaataattatagcagcactgttcacaatagccaaagggggaaaacaacgcaaatgtccatcatcaactgataaatgaaaaaacaaataatgaatttcatacaatatcatgttgtatagcgatgaaaagaaatgaagtactgatacatgctacactatgaatcttcaaaatattgtgctaaaggaaaaaagccagacacaagaggtcccatattgtatgtttttatttatatgaaatttaaagaataggcaaatctgtagagacagacacagaaagcaggttgatggttgtcaggggctgaaagaaatggctgcttactgtgaacagagtctatttagggttgttaaacaattgttagaactagataaaagtggtggtcatacagaattgtgaatatactaaatgccactaaattgtatactttaatacagttaattttatgttatgcgaatttcaccttgattaaaaaaatacagatggccgggcgtggtggctcccgcctgtaatcccagcactttgggagcccgaggcaggtcgttcatgaggtcaggagtttgagaccagcctggccaatatggtgaaaccctgcctctactaaaaatacaaaaattagccaggcttcgtggcacacacctaaaatcccagctacttgggaggctgaggcagaagaatcgcttgaacccgggaggtggaggttgcagtgacctgagactgtgccactgtactccagcctggtccacagagtgagactccatctcaaaaaaacaaaaaacaggccaggcgcggtggctcacgcctgtaatcctagcactttgggaggtcgaagcaggtggatcacctgaggtcgagagtccagaccagcctggccaacatggtgaaaccccatttctactaaaaatataaaaattagctgggcgtggtggcgtgtgcctgtaatcccagctacctgggaggctgaggcaggagaattgctggaacccaggaggtggaggctgcagtgagctgagattgggccactgcactccagcctgggtgacagagtgagactacatctcaaaaaaaaaacaaaacaataacaacaacaacagcaacaaaaaaccatagatgtggctataggggaaaaatcaatgaatatgaggatacaatgaactcatatgggattaattgatgttatttctcttttctttattcactttactaaattcatgtttttgtctaatcttctaagaatcatgagaattgatctaagagtttactgattagaaaattttcccaaaaggaaaaaagatacttatgtctttgttttaggagtagcttctgcttagaaaataaatgtgaatttattacttaggtgtcagagtgtttattttaattaggaaagaacctgtctgtctctgaacactgtacagcttctttttaaaaagccaaaattaattacatatgccactgtcataatacgtaatataacctattgactctagaatttgagttgttagctctgtcttataaataaatataattttattgctcaatgctttttaaagtgtgaaaggggccattgatgtcatattgaaaatgcctataagatgcttttacatctgcaatctacaaagagacattgataatgggaccataaaagaatacttgtgaagctagtccttagtgccactgactttttgcagtagttgtgagcatggttctatgaaggatttgatatatgttgttgcttaagtagaagggtccatgtttcacttggaattaattcagccctttctcttacagaggagcctctgcttctgttctgctctaatgacagcattctcattagaaagcccagaggggttctttaaaaatgtaaatgagatcacattactgggactaccctcaaaaccctccagacttcccatttattggacagaaaagtttaaaattcttacagtggcttgcaaagccttttgcctctgacctcatcttctattgctctgtgttccagagattttggcctctatgctattgattgtgtatactaaacatgctcccatctcaaggttgtcacatttgctgtttctactgcgcagaatgttcttctagatatatttgcataactcagtctcttaatttcttcaagtctctgatggcatgtcaccttattatgggcgttttccctaactattttatttaaaaacagcaaattctccagcacttcctatttgttattgttttattttctccataatagtcatagccatctgacatattacgtattacaaattttttacatttattgtctgattccctcatctagaatatcagctacataaagccagaaatatttttgtctgttttgttcactgctgtattacaagcacccagaaataggcctgcccttagtaggcacttagtaaatactggttgagttaatgacctgctcggtaagtggtgattcattcaatctaaagagtctgatgattcattcctgcctgtctttagttatgagtaatatttttgcccctggtaacttcctctctgtaatttctttttgaaattcctattagtcacatttatccaatatgttgtcacttttttttttgtcttttgactctatttttttaagagacagcatcttactctatcacccaggctgaaatgcagtggtgcattcacagctcaccatggcctggaactctcacgctcaactgttcctcctgcctcagcctcctgagtaactaggactacctgtgtgtgccaccacccctggcaattttttttaaatttttgtagagacaggatcttgcgatgttgtccagaatggtcttgaactcctagcctcaagcggtcctctcaccttggcctcccaaagcactgggattacatgttgaaccaccacacctggccttttaactctattttcaagagatattcttgattatatattttattctttctaatgacttccaacttttaattggtgatgtttaatttctatacattctcatttgttctattacatttgcttttatataaaatcctgtccctttttattgatgaaattggtatcatcccaaatatacttgagtagcctaattatattttgctttcatacttcttccttgaattgtatgtatttctcctagtgtaaaatattcaatttaatccttatgctctttctattttgtacaatttttttcaaatatgggtttatctttgatggttagtcattttgtaaaaatcaaggcctaggctgactatttgtagagcagattgtttccctaataggtgccttccttatctgaaagggaagagttctgtgtaattgagtaagtattgtagcctactcaacttttcttaattgtgcattggaggattggtgaataaccaactcactctgtttcttatcacttcataattaattgaaacagaatcgtgtgtgctgaaaaccttccaatgagcctaactttcccaggctgaacatattattattattgttattattattttgagacagagtctagcactgttgcccagggctggagtgcaatggcgtgatctcagctcactgcaacctctgcctcccgggttcaagcgattctcctgcctcagcctcctgagaagctgggactacaggtgcgtgccaccacgcccagctaatttttgtatttttagtagagacatagtttcactatgttagccaggctggccttgaactcctgacctcgtgattcgcccgcctcagcctcccaaactgctgggattacaggtgtgagccactgggcccggtcatgaacacattatttctttagagaacagtcttttggtagtaagcactgggatgcttctgtataaaccggaatggcaagtggccagtgtggtcagatgcagccattccttttatgttcctttaaatattcaccttctgtgttggtacttccacctgcacatcttccagttctgactgtctggtattccagagctgtgttaggaggattggcttccacctcaactgtcagtagcactttcagactggcttctttcacttaacaatatgcatttaagattgttccatattttttcatggcttgatagcacatccctttttatcactaaagtattctaccgtatgaatgcaccacagtttgtttattcacctattgaaggacatgttggttgtttccaagttttacaaatataaataaagctgttgtaaaaattcctgtgcagttatttcccagctttattgagatattaattgacaaataaaaattgtacgtattcaagttgtatgtgatgatttgatatacatatgcattgtgtcatgatcactacaatcaaattaatcaacacttccataaccacacataggtatgctgtccgtgtgtgtgtgtgtgcgtgtgtgtgtgtataaggaggtgaggaaacctaagatctactctctcttagcaaatttcaagtatacgatatgatattatcaactctagtcaccatgctataaattacatcctcagaacttcttcatcttatacctgaaattgtgtacccttttaccattatctccacatttcccttaggctttcaggtttttgtgtggacaaacgttttccactcatttgtgtaaatatcaagaagtgtgaattattgaattgtatggtagcgctatgtttagttttgtaagtaactgacaaaatgtcttccaaagtggctatgccatcttggattcccaccaacgatgattgagagctcctgttgctctaaatccttgtgttttaatacaattttgtaaaagtattatagtccaagaatacgaaatgtgcccaatatagaaaattcaaatttatccctaatcctattaaaaaaactattttctgctactatgtgtgtatttatatatacacagtcatacagtgtatatatgtttgctttctgcctttttcatttaaagacacatcatcaaagaataccatgtttttgcacactcttcagaagagcacttttttttgggggggtgggcaggcagggagatggagcctggctctgttccccgggctggagtgcagtggcgtgatatcgactcactgaaacctctgcctttcaggttcaagcaattctcctgcttcagcctcctgagtagctgggactacaggcgcacgcttccatgcccagctaactttttgtattttagtatagacagggtttcgcggtgttgtccggctggtctcaaacccctgagctcaggcaacccgcccaccttggcctcccaaagtgctaggattacaggtgtgagccaccacgcctggctggggtagaagagcacttataatggtagattaattctgcattatttggatttgctacaattgaatagctatttctccattgtttggaattaatgtggtttttaattacctcatcataaataacaatgagatcaatgtacttgggcctgttagagtcctccatctaaaaattggttggatttcagaatatgctcaagtgcttagcacttttaagttttgaaagcaggaaataaatgttaaattaacatttaggaagttagaaaaggcccaaaatgaggatcacggaaaacccatatatgatacctactttgacccggtattctaagcacgtaattggtattaactcaagtaatgctcacaagaatctgaggagactttgaagcattattagcccaattttacagctaatgaagttgagtttaagtaacttgcttaaggcattgtacctagcaagcatgggattgatgattcaaatctatacagcctggctctaagcaatggtcttcacagtttcactccattgttgagagaacatttgacttgcatgatttaaggtagaataaaaatcttgatagggccatatagatctcattatgtcctctagtcttacatatggtctattgtctctttagattacctgtcctacatgtagaggcatttgagtttgcagccccatggcaaagtaatgaaaaacctattggttatgaggtcactagtgcagcctaacaaagacatggcccagctgcttatgttgcaagtgttggaaaactgatcaattttctaacatcacttccctaaaaatacattttggtgtgtggatgaataatgctgaataaataccagatagctatgtatactcacagttctgaaaatacatgatccccaacacaattttagttgtgccttggtgcagacgaattttttcacttttatttctctgagaaactattttaaacccacaccaacctcattaatttccacatcaaacaatagggctttgactatcagcagatgtttatactatctgttagccataaaaatttaggacactactcaaattgtaggtaacaaactaatggctctttttgcttgtcattatccaacatttttgttgaaagacccaaagtcaaagaggatggtccatgaactaaatgaattacaaatccatctaaggccaaaacagaagaatgtaattttaaagatactgagcctatgcttttacaacctgaactccctacaaaaatgtgaattcttatgaaagacaaataaaaatttattttcatagcatagattaggaaaattatgcacattttatagattatagacaaattaatatccactttataataggttatggcttactaaataagtaatgtttaatttaaaaattcaaattgtaaatactcaataatatttaaaatatttgtatactttttttttttgagacggagtctcgctctgttgcccaggctggggtgcagtggtgcaatctcagctcactgaaagctctgcctcccaggttcacgccattctcctgcctcagcctcttgagtagctgggactacaggcgcccgcctccacgcctggctaattttttgtatttttagtagagacggggtttcaccgtgttagccaggatggtctcgatctcctgaccttgtgatccgcccgcctcggcctcccaaagtgagccaccgcgcctggcccaaaatattcgtatacttaaaatagtagtcgaggctaggcgcggtgtctcacgcctgtaatctcagcactttgggaggccaaggtgggctgatcacaaagtcaggagattgagaccatcctggccaacacggtgaaaccccatctctactaaaaaaaaaaaaaaaaaaaaaaattagcatgttttatgactttgtttatgttctggttgcatatgtacattcactttaagaaagttattctagctttacacttatgagtcttgtacttttctgagtagatactgtatgtagttcaataaaaatatacttcaaacaatatatttctaagggaaaagagttctgaaatataacataaccattttgacatactaaaatatatactccatgaagcattacgttaactgcaatatagacacacacacacacatatatatgtatacacatatatatgtatttccatgtgtagatataaattgacataatctatgattgagtcatacgtactcagacaggcatggtggtgcgtgcctgtaatcccagctacttgggaggctgaggcaggagaattgcttgaacctgggaggcagaggttgcagtgagccaagattgcgccactgcactctagcctggcgacagagctagactccgtctcaaacagaataaaaataaaaatgaatagtcactgtttaacctttcttgtccagtttttgtgtttttaaaacatcctgcagaaatgtgtatctttccttggggttgcgggggtatacctgtgatatgtggctttttaaaaaagcttttgctgcttttttttttcccctttttttggagagagagtctcactcggttgcccagactggagtgcactggagcaatcattgctcactgcaaccacaaacttgcctcggcctcttaaagcactgagattacacgagtgagccactgtggaaggacaagctgcttttatttatgcatattaatttctttatcacacattttatttttaaaattatttctagtgtcttgagtttaatgttcattttttatttttcatccattattttttcaaatatgaaagaactcaacactatgaattgtccatggagtataaatttggttgccttttatagatttttataggtaatattctaattatttcattttattaatattttctaatggaagttccacattttccaattttgcttgagggttgcttataaaagttttgtttttatggttgtttattttcacatctgagaatgttttgtttttagttttgtgcataatttataattgggtaaactcttctgcaacatcatctctacctcctaccttgcatgctattctatagccaatcattttcttttatatttaccaaatatctcttaaatgcaggccataagtctgacacctcactaggatgtaataatatacatgaagcatacagtgtatctggattcaatgatcttacaatgttggtctagtggcatacagtaaacaaataagagcaggcatggtaaacatattgagatcatatatatataaaagttgagtggggtcacaattgagagaccgtgagatttcagagaaactcttcatagagatgaaagatgagaagagttttgaggggagaggtatttacctagtagaaaatatttggatggaaactttctgaatagagaacaacattctgtattctaaaatctaataactttgtagagggctccttcttcttctgtatgatctcctattctgtgctctttatcctgtcttacttccatctcacacagatacaatttttcattcactttctcttcttattttaaactttttccttctcactcaactctttccttccaaatttatgaatatatccagacggcactcattctaacacacatgtacacacacattcctcctcttaactcttcatcctgttcagctcttgctcttgcccataatcagaactttctgtcatgattttctcattgttcttgcttttctcaactcatcataatgtgactcttatcccaggaatggcaggaagttatttcgctgagatcaccactgacgatctaattgcaaaatctaatgggcatctttcattactcttacttttggaggcacacgatcatattatgcacatatatattgccgacacaatcccgatattatctggattaagattgtttgcatgtatgtcccttaatagactagaaaaatgtgagggtaagagatattatgtattatctatctttgatctatctttgtagccctaatgtttagatcagtgcttagtacataatagacactaaaaaatttagtgaactcagtggtgccagcaattattcagatattgagttctcctggggagattctttgtgatgtgctgatgcatttaggtcaactctgtccaattatcattttcatgtcctagagtcattctaaacactctagctcctgagcgtatgtattactttaatgatatctttaccaatgctttggtgtgttagtctattcaggcttctattacaaactaccattgacaagctgttttacaaacaggaggaatttgtttctcacagctttagaaaaccagaaagttcaagatcaaggtgccagcagagttagtgcctggtgctggccacttcctgcttcatagacagcattttttgttgtgtatccacatgacagaaagggcaggtaaatatctctggagcttcttttttaagggcactgatcccattcatgaagactctactcttgatgtaattatctccaaaaggccccacaaccaaataccctgacattggggattaaatttcaacatacagttttttggtggaatgcaaacattcagaccatagcaactgacataaatatgttgaatcattccctcattcaaaaggggttttccatctaatggatgtagatgttatgagtagagaatcagagaccccactgctgtggaagcagaccctccaaattagggcaatttttctactggaaggttttgaaagcttcaacaggccacaatagtttcatttgagacaaactctaattccatgtaatatatgtgtaatgtgtgatgtgcaaagtgtgtttgtgtgtgtgtgtctgcgtatgcatagacacatccgtgcatgtctgtttatctcatagggatcttggttttacacccaagaaaaaagtatggcttctcttaattctgcttcttcttaccagcccttagaattcaacctgcttcctgtcacagaaaggtatatgactatcttaaaatatgattttattagccccctttttctctattatgatcttggaaacttgtcattattattcagattagctttactactgtattaatgagataattaatgtatgtaaggatgtatgtgtgagtgtcagtgtgtgggtatttgcatgcataattttgtttttttcttgaatttcactgaacagatttgtcatttacatcatttggatacataatacattccatttgtgtaagtgttttttttttttttttcatcttttgaaaattaacaatggctatctggagccaaagattttaccagatagaaataaggtttctctttattatagaattgacattttcaatttttattataaaaagcaaattgaagtctttaattgcctgggttttatgaatgtattgaattttctaatttcaatgttaatggatacatatttctttctagatttcttttcttttaaataataagcaactggtttgacatgcctttaatcaagatttatcatgaccttattagaaagttaatgtttggaacatttactctctgatgaaccaccaattttgtattttacatttatctgcaatttccaacagtgaagaggttgtctgcaaatggaattaattcttctccatttggttatcatctcctttgctccaatccctggtaatagctaagcttgttcaagatattaaagaggtagatcaaggatctaaatggtagggaaaattttcaatttcttaaatttcatttattatgttgataaatctggcctctttgatagtttgtcattttcatagaattgattattcattagcaccattgcagaccatatagctaccatctttgcttaggttttctagcctctggatctgattgagaaaggaagacatttgaaagcatatctgagtacacatgactcaatcattgattatgtcaatttatatctacacatggaaatacatatatatgtgtatatatatgtgtgtgtgtgtgtctatattgcagttaatgtaatgcttcatggagtatatactttagtatgtcaaaatggttatatttcagaactcctttcccttagaaatatattgtttgaagtacattgttattgaactacagtatctattcagaaaagtacaagactcataagtgtaaagctagaataactttcttaaagtgaatgtacatatgtaaacagaacataaacaaagtcataaaacaaaattactagtgcctagaatcacccttatatttcctaccaggcactcacttcttacaattacaacttttgacaccatgtattatgactgaacttttgtgtacttccaaacttcacatgtggaaatcctaatacccaatgtgatggtattaggaggtagggccttagttttaggtaatgaatgtggatcccccacgaatgatgctgtgcctgaatgttggtgtcctcccccaatttgtatgttggaacataatatgcaatgtggtaataggtaagggaaagtaattaagggaaagtaattaagtcatggggactctacccccataaatgggattagtgctcttataaaaaagtttaaaggagcattctggtttcttccatgccttccagcatgtgaggacacagcattcatcccttctaccatgtgaggatatagcaagggtgtgccatctatgaggaatgggccttcgccagacacaaaacttgtcagtgccttcatcttggactttgcagactccaaaactgtgtgatataaacttctgttatttatacattattcattctaagatattttgttataacagctcaaacggactaagacaaatgaaaattgcccttataagaagataaaccacggcttcttttcttggtgtttggttttcaacatgtgaggacacagtaaaaagacatccttctgcatactaggaagaaggccataaccaaaatccagcaatactggcaatcttatctcagacttcccaacctccagaaccatgagaaatacatttttgttgtttaaactatccagtctatggtatttttgctatagcaggtcactgggaggattccccttcaatggaattgaatgcaattcagcttaatcagtgttcaagatatagcgctgtttctctgattaccaggattcaggggttcagacggaaattggagtggtggtaacattcattattacctctactgacctacaggcaaaaattttgtttcctgttcctgtgactttatgctctgctagcctaaaggtcttaattccagagggagggatgtttccagaaaaagacacaacaatgattgtatcaaactggaagttaagactgacacccagcaattttgggctcctcctgcctcagtcaataggctaagaagggaattactttgttggctgggacgaatgatcccaactaccaagaagaatatggactgtgactctacaatggtggggaggaaaaatatgtatagaataatagaaatcttgtacggattctcttattatgactgtgcactgtaattaagatcagtgaaaatcgaaaacagcccaatttaggcaggactatgattggcctaggcccttctggaattaaggtttggttaccctgccaggtaaaaaatgacaaccagctaagatgcttgctgaaggcaaatggaatacagaatgagttgtagaggaaggtagtttgaaataccagccttgatgatgtgaccggtttccaaaaggaggactgtcatcatcatgagtattcccttcttattttgttatgaatacagttgtgtttatacacaaatacgtgtgtgtgtgtgtgtgtatatatatatatatgtatatatgtaaagcaaatgcctttgatttattttctctgttattctataataatttaaaataaaacatattgactttatattagtatttaaatattgtcaatgttacatcatagtatttaagttacgggatgtcaggagaggagtaaacatcactcatttactttactttctcttgtgtggagatcaatggattttttgttgtatgcagaatagctgcatcatgtcaggaggaattatgaccattttcctgtcttaatttggagattaagtatggcttgaggagatgtgtacatgtgcccagttgacaaggggtcttcttgttatggttcatttaatgtgttgacctggactgtgctaagggatgctcagataactagtgaatcattattgtgggtgtttccatgaggatgtttctgaaataaattagtatatgtattggtgaactgagtaaatgtaaatgcccctgctcaatgtaaatgggcatcatctaatctgttgagggcctgaataaaataaaaaggcagagaaagggtgaattcactctctatgcttcagctgggacattcgtcttctgctgcctgtgaacataagtgctctggttcttaggcctttgcatttggaccgggacttacacagtggttcctctggtcactgggccttcatacttggactttgtcatttaacatcaactcccctgatgctcaggcctttggacttggactgaaactataccactctctttctggtcccccagcttgcagatagcagaacataggacttctcaacctctgtgattgtgtaagccaattccttataacaaatcttatatagctagacatagatagatgatagatagatagatagatagatagatagatagatagatagatagatacatagatgatagatagtaagtagatagtagatagatcgatcttctcttgcccctttttctctggagaatcctaagacaactggttgaacatcttttcatgtgcttgtttaccatctgtagatcatttttcagtgaaatgtctgttcataccttttgaccattttccagttaggttattattaattttttacagttgacttttaagactactctacatgttctggatataaatcctttgttagatacatggtatacaaatattttctccctgtctgtaccttggttttcttcctcttaaaagaatctttagactttgatgaaatctaatttataggtgtgaccattcgtgcagtaccccagtatgttgttatgctatgactaacctgcagtaaaatccatctacccaatttataatttcatttattttgttttttcaaaatttctagttaaaacaataaattctaatattctaatgaaatcattcacttttttctcttatctgccattatttgccttccaactataatatctggaatacctcagctctgttattattttatttgttaatcttccttttggttataggattctgtcttttggtaggaggaagtttttgacgaaggcaaggtattagttataaacgaagttacacactccatgtggtaatattttcctgcacacatagtttcgaatttcctctgctaagcagagagaatgaggactgttcactttaatcttaacagagagactgatttcaataggagcttcattgcactttttgtaaagcttggtagacttctgctttgacactgatcccagggtacatactttcaactacagtgtgactgagtctagaccttacaactgagagcctggtatcataactgagttcccttcactggctggtcctcagctttccttttcatctcctgagcaaaaataaattgcagaaaactttacaccactttacagagaatatcagcttagcttttcagcaccttgctacttgtagcttcagaatttggcaaactttttgaaaataaaacaatacacattcaatgcccagttttctgctatttaatatgttgaacattttgtgccataaagctttcaattttctctctagtttgttgacactgacaaacactttgcttatacctctgtctttcagcaaccattctgcctgagcaaagactggattttgagctctcagtccatttatgacaaaatggactcctgaggtaaaagtatctactcaactctcagtgtttcttctctctcccagaatcttgagcactctggtcttgtttctgtattagttccctaatgcttttaagaaaaagttatttatattttatgtaacttttctactgtctttttctctgtgaagcattggttggctttgagatactttatttttttgtctttttgaagtacttttaaaacactgaagcacgaaaacagaggcacaatcagttttgttcatagttgcatcttgcacaaggatactcgtattacataataaatttggaagataaatttgctgttttcaaataagtaacagactgcttttgtggaataaaaaagtggaaaatttgttttttttgtgtgtattcacagagtcgtttctatattttatctaaatttgtatattctaagtagaattgaatggacaaatcatttgttttgtccattattcatataatggacaaataattaatcattgtgtcaaatcatttgaagtcagtaacaaatttcctgattaaattttgtttgctgctctacacttgaatttttaataactttccagctattaaattgctatgttataacatcattttgaatattattgataaggatcttgttacaaactgcagaaatgttactaggtaaaatgagtgtttggcctagccaccacatatgcaatttagaacaatgtgatttccattcgttcatagaggtgcgatccccacctctagccaaagatccacagccacgcagggtgcatggtggctccccttctcaccccccttccctcctggatggggtgcttgggcggatccacggcacacacctgtgtctgcacatgtggggcgaggggtatgtttgcaatggccatgcagggtgggagagaactgtggctgctgcccaggccccagggcagtctcaggggccaggggcctcacgtggctagttggccagcatgtcccacccgccatcccctcctgccatgtgcccatagagtctttcctccccgggcgagaggtccggctttgtccgagccagaggaaggatacagtgatttaaggaatccatttgcatagaggaagaggttcttctccacctaaatcgattttttttctttttccttttctatgtgagaggtttcttttcctacctctgcactctgcttatgataggaaagcaacagaggagccatcccactggctaataacggcaaatttggcaaagtctgtctgggacttaatctaaataaatccatgcatcccccgagacacctttttgtcccaaactcaattacaaactttggttgaagccctagaaaggaaaaccagatctgagggatccaaagccaggcaacaggcacagagtaaatgggcaggactaattcctgttgattaagcccctgcttcatggaaggaggccatgttccatgtcatatatagataaggcctagggaactcaagagatttcatgactatgaattacagtaaaaaataagtactcttgcaaaacacagttggattgtttgtaacacaaagaataaatgcttgagaagatggaaaccctattctacatgacgtgattatttcacattgcatgcctgtcaaagcatcccatgtaccctataaatatatacacttactatgcacccacaaaaattaaaaataaaaagtaaaaatttagaaacaaacaaacatacaaaaaccaaaacacatcatacttcagttttgaaacattaaggtcccaattatgtttactcaaaaataggtttttaatttggtagtttttttatttttgagtgtgaatataaggccaagcttgcttctattcttataatttgagaatttaacaagcattgtttatttgtggacgtcaaactcttttttatttgacatatacaatataatatatataattataatattatatattataaaatctctactaaatagatatatttagtagagatggggtttcatcatgttggccaggctggtctcgaactcctgacctcaggtgatccgcccacctcagcctcccaaattgctaggattacaggcatgagctactgcgcccagcccctcactatctttatgagcagacacaacaaagatttattgagtaaatactatgttcagggcactattccatgtactaaaggatttttaaagataaataagacatggctcttatctctgaggtgttcacattctcatgtgaataggacaggcttatatacaatagtctaacacgaggcattatgtgaaaagtatatttcttcgcctcttctcactgcttagaaaagtgtctagaacatagcgtgcactcaattaatactttctattagcattaatattaatcttgtcatcattggaaaagatataataggaactgacactggagaaataagtcaggtccaaattatagaaagattactatggtagtcaaaatcccccacttctcatctccactgacactccaaccttgatctagatgtggttatacctccataatctctcactttgccgcacagtctccccattggtgtccttgactcttaatgtgcactcctccatgttcaaaaaacagaaccattcttaaaatataagtcaagtcatatgatacttgtgctcagaatcatcaatggattccaaattagataaaagtataagcaaaaaagccctattttgtcctaaaatgccctacagatctgtgttcccactatttctctgacttcgtcttttactcctctcttctttatttttctcaagttacaatgccccattggtattccacaaaaacggcaaacatacttctatctcaagtcctttgcccttgctattccatctctctggaaaaactctttacccaaatatcagcatgaccaactccttcatttagtccaagtctctgtgcaaatacctctgtatcagagagtctttaccttatcatcctatgtaaaacagcactccaaatgaccctctttaaattttcagtatgccactcatcaccacctcaaatattgtattcactgtgtgttttactttaactcttccccaaccctagattataaactctgtgactgaaaccgtaactattgtttgctactatattatcagcagtagaacagtgcttgactcatagtgaggtcttgatgaatttggttgaatgaatcacttaatcaattgtcccaactttataaactcaagtttaaggtatctgaaaattctagtctaatcccaaaccatattgatgtattggtccttatttaaacccttaaaaaataggcattaattgctttatcatgcagtctcttttaattagtgtaattttgactagattgatatgctggtttagtaattactttgtgattttatatgtatatgttacatgcttggattataatagaaatgctagattttaaagttactgaaacctataagaaagcagttttgtcttatttttttaaatataactcagccatcttttctgtacacacacatacacacacaacctcatagatgtggttttaccaatatcaatttaaagaagggcactatgatgtttgttttagatctgtacttcctaaattatctgtagtctaagaacagtttttctctccatctaccatggattcacacttttataaaataaaataattcattaatataaacttaatagagaaaagcaaagacatgagtcaagtctatgttttaaatgattagattcaagagacataaagttttctgtaaacatttcttttttaacattctgtttcaatttatgtacttatcacaaaccagaatcaaacaattcctggattagcactggtatccagacctaaatttgagtagcattgctttatatattaaatttcgaacacctctctacaaagtatttatattccagcttttttaaaagtaaaaactgactataagagaagttaacgtaatacagtaaagactatttaacaggaacatttgatgaagtagatcattcccgtcttctaaaaactttcactttctttgtttttcattacaccttgttcttctgatttgtgtttttcccctctgatttgtttcttttctgtttccttcacttcttcttacttatccaaagattacagtatctttgaaatatgttttgaactctcgtcttttctacatcaaaatacacttcctggctccaattgtgaactataaaacattgattaaaaatgtatatctaacttctgatctctctgcacattgtcacatttgactactgtattaatcatttttttaaatgttatgtattttatgatgtgttgacatcttacaaaggctactagccatgtaaagactgccagggccagggctagccaattctttgagttagtaaagggccaggttgggagcatgtcttgcatgtgcaatcgagccaatctttggtctatagaccaaagtctatagctccattcacagccttgtctaactctttacacaccaagccaagatttaccttgccctaaatcacctagggccaaatataaaaaaaaactggagaccgtctttatacctcaaggccctttcaaattattcaaaccagccaatattaagttgtttattctgtccggccttgcttttcccatagaaacccccataaagactctggctctggattccctttgcttctatctttttccatgtgagaaaagcctagccctctgtggtcctctgtgacatttggcgaccctactctgttggacctgtaaatataatcaaacctcttccttctaggccttgttcttgttttcctttgcagctacactgactgtaccacaccacatttttcgaacttttatgcgtgcccatatgcctcacaaacatatataattcaacatacccactattgaaatgaacattgtctcttcaaacgttttccttctgttaatatttcctacatcagcaaatggaaacatactctttcaataaacacaattgggaaactttaaagtcatccttgactagcctagtttatccatttatcttttattattcaatcaattggtaacaaagttctgcctccaaaatgtatctcaaatatcatttacttctctatcatttttacaaatatcagtatagtccaggacacaatcatctccatcatgaagtcctgactggcttcccagtttctgctcttactcatcattctgatctatcttccactaactgccacgtaatctactttttaaaatagggtaagattgtatcttgttttcctgagacaattgtaattttcatctattatctcatatagtgattaatggtaccccttcctttctattaagtgagacagtatgtacaatatattctatcttcacgctacctaatagtcattaaaataatttattgagccatgacaaagtaattggctccagaatagtttcattctcttaaaaaactagaaaagcatattaaataagttcgggctgtggaaagcagatagtaaaggatagcaatcactaagaaaagtgaaaacactgaagtaagtcctatgatcacccaggatttctccctgcgggtaactgtaggctatggtgcaaggacaggaaatccctacatatcgtagtagttctattaaattgaggatactgagttaagaaagccttaccaactggaatttgtcagatagagtaatagagaagggagggtgagagtaaaaaatagattcaggtccgggtgcggtggctcacgcctataatcccagcactttgggaggccaaagtgggcagattacccgagattgggaatttgagaccagcctgaccaacatggagaaaccctgtctctactaaaaatacaaaattagccgggcgtggtggtgcatgcctgtaatcccagctactcgggaggctgaggcaggagaatcgcttgaacccgggaggcggaggttgcggtgcgccgagatcacaccactgcactccagcctgggcagcaagagtgaaactctgtctcaaaaaaaaaaaaaaatagattcaaaaatgtacatatggattcccttgggtctttcactaaatgttaagctgaacatgcacagggtgaaattccataaggctagacagagagcaactgggagacaactgtatgctgaacaattcccagaattcacataggcctaagaggcattttcagtagctagagtggaaaaaacttgtttagcacctagggcattcagtgaagacaccagaatggctatttctaaaaagtagacctaaaatgtcctcagagtaaaggatacttctgactcatgttaacaacacttaaaaacaaaccttaaaagaattgagctgatgcgcgaaatcttatatcaactatttaaagaaataaagcaaaatccagacaaccaataatgttacattatcaagaaatcaattaataattagaagatgtgttaggaagcaggaaaatataacatataaccaaggggaaaatcacacaaaagaaatgaacacagaaataacaaacatgataaacagaaaaaaaaactttaaaatggctattacaaatgtgaagaaggccttaaaggaatatataaacatactgagaaaaaatagaaatatttttgttgtttttaattgtttttagacttttcttctatcctttttttttcaacttttattttgagttcaggggtatatgtgcaggatgtgcaggtttgttacataggtaaacatgtgccattgtggttttatgcacagatcatcccatcacctaggtattcggcccagcatccattagctattttgcctgatgctctcactcccccaacaccaagcctccaacaggccccagtgtgtgttgttccctgccatgtgtctatgtgttctcatcattcagctcccacttactaatattattattttttccgaggcagggtcttcctctgtcgcccaggctggagtgcattggtgcaatctcagctcactgcaacctctgcttcccgggttcaagtaattctcctgcctcagcctcatgagtagctgagattacaggcacgtgtcaccctgcccagctaatttttgtattcttagtagagacgaggtttcaccatgttggccaggctggtcttgaactcctgacctcatgatccaccctcttcagcttcccaaagtgctaggattacaggcatgagccaccgtgcctggccctcagctcccacttataagtgagaacatgtggtgtttggttttctgttcctgcattagtttgctgaggataataccttccaactccatccatgtccctacaaaggacataatctcattccctttttatggctgcatagtattccatagtgtatatgtaccatattttctttatcctgtctactactgatggtcattttgggtttattctatgtctttcttattgtgaatagtgctacaatgaacatatgtgtgcatgtatctttataatagaatgatttatattcccttgggtatatactgagtgatgaattgctgggtcaaattgtatttctgcctctagatctttgaggaattgaaacactgtattccacagtggttgaaataatttacattcccaccaacagtgtaaaggcatttcttattctcagcaaccttggcagcatctgttttttttgtttgtttgtttgttttgacattttgataacagctattctgcctggtgtgaaatggtatctgtattagtccattttcatactactatgaagaaataaatgagactggataatctataaagaaaaaaaggtttaatggacttacagttctgaatggcttgggaggcctcacaatcagggtggaaggaaaaggaggagcaaaggcttgtcttacacggtggcaggcaatgtgagagagcaagtgcagggaaactgcctttataaaaccatcagatctcatgaaacttattcgccaacatgaggacagcatggaaaaaaacccaccccatgattcaattgcttcccaccgggttccgcccacaacacgtggagattatgggagctataattcaagatgagatttgggtggggacacagccaaaccatattagtatctcattgtggttttgatttgcatatctctaatgatcaatgatgttgagctttttttcatgtttgttggccatatgaatgtcttcttttgagaagtgtctgttcatgtcctttgcctatggttttttttttcttgtaaatttatttaagtttcccctagaccctggatactagacctttgttagatggataccttgcaaaaaatttcccccattctctaggttgtctgttcactctgataatagtttattttcctgtgcagaagctctttaatttaattagataccacttgttaatttttgcttttgttccaattgcttttggcattttcatgatgaagtctttgcccatgcctatgtcctaaatggtattgcctagattttcttctagggtttttatagttttgggttttacatttaagcctttaatccatgttgagttaatttttgtatatagtgtaaggaaggggtccaatttcaattttctgcatatggtttgccagttctcccagcaccatttattaaataggaaatcctttccccattgtttgtttttgtcagatttgttgaagatcacttggccgtaggtgtgtggtcttatttcttagttttctattctgttccactggtctatgtgtctgttcttgtaccagtaccatgctgtttggtttactgcagtttaatttgaagtgtagtgtaatttgaagtcaggtaatatgatgcctccagctttgtttgtttttcttaggattgtcatggttattcagggtcttttttggttccataggcattttgaaatagttttttctagttctgtgaagaatgtcagtggtagtttaatgggaatagcattgactctataaattacttaaggcagtatggccatttttacgatattgattatttctatctatgggcatgaaatatttttccatttgtttgttttctctctgatttctttgagcagtggtttgtagttctctttgaagatgtccgttactttccttattttatcctcttcatagcaattgtgaatgagagttcattcatgatttggctctttgcttgcctgttgttggtgtatgggaatactagcaagttttgcacattgattttgtatctagagacattgctaaagttgcttgccagcttaaggagcttttgggctgagatgataaggttttctagatgtaggataatgctatctgcaaagataatttcgcttcctttctttttatttgaatactctttatttctttctcttgcctcattgccctggtcagaacttccaataccatgttgaataagaatggtaagagagggtgtgcttgttttgtgccactttgcaagggaaatgcctctagcttttgctcatttagtgtgatattggctgtgagtttgatatatgtgaatcttactattttgaggtatgttccttcaatacctagtttattgagagtttttaacatgaagggatgttgaattttatcaaaagccttttctgcattgattgaaataatcatgtgttttttgtcttttgttctgtttatgtgatgaatcacattcattgctttgcatatgttgaaccaacagtttataccctctcagatatgaagccaactggatcacgatggataagctttttgatgtgctcctggatttggtttgccagccttttattgaaaaatttttatatcaaggttcatcaaatatattggcttgaagtttttgttgttgttgttgttgttttgtatctctgccaggttttggtatcaggatgatgctggcctcataaatgagttagaggggagtccctcaattgtttgcaatagtctcagtagaaacggtaccagctcttctttttacctctggtagaattcatcctttagtccttctggtgctgggctgtttttgccttggtaggctatttattagtggctttattttagaacaatttctcagtctattcagtgactcaatttcttcctggctccttggtagattgtatgtgtgcaggaatttatccatttcttttagattttctagtttattttcatagaggtgtttgcagtattctctaatagctgtgagtagttcattggggtcagtgatatcccctttatcatttctgattgtgtatatttgattctgttttcttttcttctgtattaatctagctagcagtctattttattttattttatttctcttaaaaaaacagcttctggatttgtggggttttttttttttttgaagaattttttatgtccccatctccttcagttcagctctgatcttggttatttgttgtcatctgctagttttggggtttgtttgctcttgattctctagtttttgttaaaaaaatttgtgatgttaggttgttaacttgagttctttttaactttttgctgtgggcatttagcaccatgaatttccctctgaacactgctttagctccatcccagaaattctagtacattgtctctttatcctcattagtttcaaataacctgttgatttttatcttaattttattatttacccaagagtcattaaggagcggatcgctcaatttccatgtagttgtgtggttttgagttcatttcttaattttaagttcaaatttgattgcactgtggtccaagtcttttgcatttactgaggagtgttttacatctgattatgtcatcaattttagagtaagtgctgtggggcaatgagaagtatgtatattatattttgttgtttttgggtagagacttctttaggtatctaccaggtctgcttgatccagagttgagtcctgaatatcttcgttaattctctgtctcaatgaactgtctaatattgttggtggggtgttaaagtctctcactattattctgtgggagtctaagtctctttgtaggtatctaagaacttgttttataaatctgggtgctcctatattaggtgcatatataattaggttagttagcttttcttgtattgaacattttacctttatataatacccttcattgtcttttttttatctttcttgatttaacatctgttttgtcagaaactagaattgcaacccctgcttttttctgctgtccattttcttggtagatttttctccatctctttattttgatcctatctgtgtcactgcatgtgagatgggtctcttgaggacagcataccaatgggtcttgactctttatctagcttgccattctgtgtcttttaattggggcatttagcccatttacctttaaggttagcattgttatgtgtgaatttgattttgtcatcacgatactagctggttattttgcagacttgtttatgtagttgcttcattgtgccattggtctttgtacttcagtgtgtttttgtagtgtttggtaatggtttcctttttcatatttagtgcttcctttagaagctcttgcaaggcaggccttgtggtaatgaatttccacagcatttgcttgtctgaaaaggagcttatttctccttcacttatggagcttagttttgccaggtacaaaattctgggttgaaaattcttttctttaagaatattgacagccaggcgcagtggctcacacctgtaatcccagcactttgggaggccgaggagggcagatcacgaagtcaggagatcaagaccatcctggctaacacggtgaaaccctgtctctactaaaaacatgcaaaaaattatctgggcgtggtggcgggcacctgtagtcccagctactcgggagtctgaggcaggagaatggcacgaacccaggaggcagagcttgcagtgaactgaggtcatgccactgcacttcagcctgggcaacagagtgagactccgtctcaaaaaaaaaaaaaaaaaaaaaaaaaaaaaaagaatattgactattggctcctaatctcatttggcttttagagtttctgctgagaggtccactgttagtctgataggcttcccctttgtaggtgacctggactttctctccaactgcccttagcattttttctttcatttcaaccttggagaatctgttgattgtgtcttgtggttgatcttctcatggagtatcttactggggttctctgcatttcctgaatttgaatattggcctgtcttgctaggttggggaagttctcctggattatatcctgaagtgtgttttccaacttggttctattctccctatctctttcaggtaactcagtcagtcatagatttggtctctttacataaccccatatttcatgcgacttttttcattgctttttattcttttttctctattcttgtctgcctctgttatttcagcaagatcatcttccagctttgagattctttcctttgcttggcctattctgctcctgatacttgtgattgcattgtgaaggatctcgtattgtgtttctcagctccatcaggttggttatgttcctctctaaatagactattgttgctatcagctcctgtattgttttattatgatttttagcttctttgcattgggttacaaataattgtgtattttatgtgtcacaaagtaatattttgatacacatacacattataatgatgaaataagtgtaattagtatatccatcacctgaaatacttatctgtgacaggaacatttaaaattctctcttttaggtattttgagatatacaatacattattattaactatagtcaccttgctgtgcagttgaacatcagaacttttatctcttatctaaatataactatacccatcgaccagcatctctaatttctccatccaaacgcttacccccacagcctctggtaaccaccattctactctctacttctatgaatttgacttttttagatttcatatataagagatattatacagtatttgtctctttgtggccggcttatttcacttaacataggttcattcatgttgcaaattagagaattttctatttgttttcatcttaatgactgaatcgtattcattttacaattatatgtagtactttaccttttaaaatgcccatagttggacatttaggttattttcatatcttggttattgagaatagtgctacaataaacatgggtgtgcagaaatacctttgccataccgattttatttcctttgggtatatacatagtagtggaattttataattatatcatcattctattttcgttctttttaaatttttaatatttaatccttgtgggtacatagtaggtacatatatttatagggtacataagatactttgatataggcatgcaatgtgtaacaatcacatcctggtaaatggagtatgcatcacctcaagcatttatcctttgtgttaaaaacactccagttatactcttttgattttaaaatgtataattaaattattattaaccacagtcatgccgttttcctgtcaaatactaggtctttattcattctttctatttttttttcttttttttttttaactcattaaccatcctcacatccccccacccctgacacacactgagtacccttcccagcctctggtaaatgtcctcctactctctatctccattagttcaactgttttagtttctagctgccacatataagtgagaacatgtgaagtttgtgttttcattcctggcttattttacttatcataacctccagttccatccatgttgtagcaaatgacaggatctcattctttttatggctgaatagtactccattgtgtatatgtaccacattttctttatccattcatttgttgatgaaaattaagattgcttcccaatcttggatattgtgaacagtgctgcaacaaacatgggagtgcagatatctctttgatataatgatttactttcttttgcatgcatacccagcatttgaattactggactatacaatagctctaattttagatttttaagaaacttacatactgttttccaaaatggctatgctaatgtacaataccaccaagagtgtataagggctctcttctgtatatccttgccaatgtttgttatttttcactttttgaaaatagccagtctaacagatgggaggtaaaactcattatggttgtaatttgcatttctctgatgattaaagacattgaactttttttcatatatctgttggacattcatatgtcttcttttgagaaaagtctattcaagttctttaccaatttataagagttgtatttgttttattgttactaagtagtttgagttaattgtacattttggatattagccacttactggatatataatttgcatatatttttcccatcccatgtgtaatctcttcactctattaattgtttcatttgctgtgcaaatgatttttaggttgattcagtgtcttttgtctatttttgtttttgttgctcaaacttttataatcatatctaagtattctgcccagtgcaatattgtgttaggccattattgcattgctctaaagaaatatctgagacctggaaattcataaagaaaaaaggtttaattgactgacagttgtgtagcttttataggaagaatggtactggcatctgcttggctcctggtgaagcctcaggaagcttttagtcatggtggaaggcaacgttggagtagtcatctcatatggtgaaaatgtgaacaagagagagagtgggggaggtgccatacataaacaatcagatcactacagcaaagacagtaccaagccatgtgagatctgcttcgatgacataaacatctcccaccaggccccacctctaacactgggattatgtccttctgaaatttcaaaatataatcatgccttttcaataggacccaaattgtcaacacatttttgaattaactcaaaagtccaaagtctaaagtttcatttgagacaaggcaggttccttccacttatgagtctgtgaaatcaaaagcaagttatgtacttccaagttacgatggggtacaatggggtatagctattgaataaacatttccattggaaattgaagaaatcagccaaagggaaggccctgtgcaagttcaaaatcaaacagggccgtaattaaatcttaaagtttcaaaataatctccgttgaatacatgtcatgcatctggggcacactagtgcaaggggtgggcacactagtgcaaggggtgggcacactagtgcaaggggtgggctcacaaggccctaggcatttccacttatgtggctttccaggtttcagtccccatgcctgctctcacaggttgttgagtggctgcaacttttccaggtacaaggtgtaagctgcaggtggatctaccactctgggggcctggaggatggtggctcctttcccacagctctactaagcagtacctcagtgggtacactgtgtggtgccttcaaccccacaatttacctccacactgctctgtcagatgttctctgtgagggctctactcctgcagcgcactttttcctggggacccaggctttctcaaacatcctctgaaatctaggcagttgctgccaagttttctttactcttttactctgtgcacctgcaagattaacatcacatggaaactgtcaatgcttatggcttaaaatgtctgaagcagtggctcgaccttatcagcctggactttaccgtccatatcactatcaatattttggtcacaaacatttaaccagtctctaagaagtttcacgttttccttcaacttcctgtcttcttctgagtcctccaaagtcttccaacctttgcccattatccagttccaaggtcgcgtccacattttcaggtatctttatgaaaataacccattcctggcaccaactttctgtgttaagctgttcttgtattgctataaggaaatacctgacactgggcagtttatacaaaactaggttttattgcctcatgtttctgcatgctatacaagaagcctggtaccagcatatgctcaacttctcatgaggcctcaggaagctttcattcatggcagaaggcaaagggagagcaggcatttcacgtggcaagaacaaaagcaagaaagatagttgggggagaaagaagagatgtcatgcatttaaacaaccagatgaccattacaaagacagcaccaagccatgagggatctatctccatgacataaaccactcccactaggccctaccttcaacactgaggattacatcacaacatgagatttggagaggacatcgaaactatgttaaatgtcacacagtttttttttttctgttttactctagtaattttattattttaaatcttatctttaagttgttgttctatttttagttgattcttatataagggtgaaatcagggttcttttttttcttctgtgtatgaatatccggttttcccaacagcatttattgtagagattatcctttctccaatgtggattcttagcacctttgttgaaaatcaactcacactagttacgcagggttatttttggactctcttctactacattaatcaacgtgtctatttttaggccagtatcattctgttttgattcctatagctttgtaatatattttgaaatcccattgtatgattccattagctttgtcctttttggtcaagattgctttgagtattaggtgttctgtagtttcatatgaattttaggattttttctagttctgtgaaaattcccattggaattttgatacggattccattgaatttatagatcaatttgggtaatataaacattttaacaatattaattctactaattcatgaacatgggatatctttttcatttacttgcaccttcttccatttctttcatcaatgttttatagttttcagcttacagtttttcactttcttggtaacatttaattataaatatttttattgtattataaataacactgttttttaaatttttttctggtgagttaattgttagtgtgtagcaacactactgatttttgtaagttggtattttattttgtagcttaactgaacttttaaatatgttgtaacaggttcttagtggagtctttaggattttctatatgtacatacattgacaaatccgaaagactctaattctgtaatggtggtggataaattaattatgtgtctattataaagtgtaaaaacaaaactattaaaaacaaagcaacaataatttgttaagaggcacatattataaaaagatgtaaagtataacaccaaaacagtaaaaaatggaaagagagtaaaattacagaatttttctctgcaatcaaaattcaattattctaaacttgaaatagcttgttacaagtataaaatgtttcttgtaaacctcagggtaaccacaaaacaatattttataacaaaacacaaaagaataaaaaagatatccaaacaatgcagtacagaaggccatcaaacatcaaagcaaaaaagctagacagaaataaaaaaaaaggccctaataaaacaccagaaaacagttaacaaagtggcagtagtaaatccttacctataaacaattacaaaaaaaaagtatatgaattaagtgtttcagttaaagggcttagtgtagctgaaggaatgaaaaaaacaaagcccagttatatgctgcctacaatagactcatctcaacctaaaggccactcatattaaaagtgaattgatggagaaacacgttaaagggagacagaaactgaaagagatcagggtagctatatttcatttataaaaaataaactttaggtcaaaaactgtaaaaagggacaaaacagttaatgacaaagtggtaagttcataaggaggaactaacaattatatttgctccaaaattggagtacttaaatacaaaacaataataataaatcgaaaggagacatggaatgtgacacaatagtaatagggtatttcaacactccactttcagcaacagacagatcattcagacagaaaatcaataagaaaacatcagacttaaactacacgtaagaacaaatggacctaacggatatatacagaacattccacccaatagcaacaggatatacgtttttctcaagtgcacaaggaacgttctccaggatggattatattttaggcaacaacacgattcttaacacattgaaataaaaagaaatcatatcaagtatcattttccatcgtaatggtgtgaaactggaaatcaataacaggaagagtcatggaaaattcacaaataagtgaaacataactaatacactcctcaacaactatttagtcaaagaataaactaaacaggaaatttaaataatatcttgagaaaacaagaatgaaaacagaacataccaaggcttatgggatgcagcaaaagtagttctaagaagggagtgtataacaattaaaatctacatcaaaaaagaagacagctctcagataaagagcttaacattacatcttaagcaattagtaaaagaagaacagactagtcccaaagatagcagaagaaagaaaataacaaaggtcagagcaaaaataagtgcaataaatacatgaaaaaaatagaaataaagagaataagagttggctttttgaaaaggtgaataaaattgacaaaaccttagctaaactaactaagaataaaagagagaagacaaataaataacatcataaatgaagaatgagacattacaattgataatacagaaatacaaaggatcataagagactattgtgaaaaattatatgccaacaagttaaaacacctggaagaaatgaatcaattcctagaggcatataacttactaagacttaatcatgataagatgggaaatcttaacagaccaataacaagtaaagagattaaataaaaattaaaaagtctgttcaaggaaaagcccagatccagatagcttcatggatgaattctaattaacatttaaagaactaatgccaatcattctgaaactcttccaaaaaattgaagagaaaaagagtacttccaaactaactttacaaggccagcctcaccatgataccaaagctagtacagtacactacaagaaaagaaaaactgcaggctaatataactgataaacatagatgcaaaaatcttcaacaatatgcatatggactccaacttagggtggttcaatttaagattttttaactttatcatggggttatgaggataatatcttcaacaatacattaaaagtgtcatcatttaccatgatcaagtgggatttatccctgggatgcaagattggttgaacatacataaatcaataaatgtgatatgtcacatcaacagaatgaagaacaaaatcaacaccatcatctcaatagatacaaatgaagcatttgacaaaacttaacatcattttatgataaagtctattaacaaattaggtaaagaaggactattcctcaacataataaagactatatatgacaagcccacagctaacatcgtactcaggaattaaaattgaaggcttttcctttaaaatcagaaaaaaataagtatgcccattctcactacttctgttaaatatagtactggaagtcctagccagagcaattaggcaagagagagaaataaaggacatccaaataaaagaggatgaagtaaaattatctctgtttctttgcaaccacactgttttaattgccagcaatgacatgattttaaatgtcagtaaaaggcaaatatgaatttttcttcaagtacaacaaaatcaaggaaactatgtagttactcatcatgtttttcaaaggcttaatagaaattcatgagacaaaattaataaaataaaaatataactcaaggcctcaaaaatttataatgattaagcaatagaattatctacagtcaatctaatgtatttacctctacttatctccccatggtccaaagaaccatcgtctcagacctaaattatttcaaaaaaacttctaaatgctacccctgcttcttcccttgctactcatcacagatgattttttacaccacaggacaaacagtcttgctaaaacgtaggtcacagaatcgttctttgttaaaaattttcagtgtttttctatttcacttttaaagaaacaaatacattatagataaattctaactaatatttaaagaaccaccacaccaaaaatctcacagtttttaacatctctgaattcattaattatttatttgaccatgctggcctctcttgaaaaaataaaataaaataatattctaggcacgtttctacctcatagcccttgcacttgctcctcctgctgcctggaacagtcttctcccagatatcctcatgactttcctccttaccagattctcgtctttacttaaatgcccccttttcattgcagtcttccttgtccatgctacaaaataatcctgcccctttatcttccttttctactttactatttgatagcttttattccatcaactacactacctattgcatttattaactttctgtctacactaatactacaatgtaatctgcacgagtatgttctgtgcacttacgttaagtgaccaaatggcttaaatttagtagacacttaaatttcagttgaatgaataaatttctttggtcctctctagtgttgatattctgacagctaatcatattatacataattgttttgttgatggaaccaccctgttacacgtgattttaagtctattcacaagtccagtcctggcaaatgtttaacaacaagatttctgatgaaaaatgcccttatttgtagaattttattaattccatggtgaacattctctcaccacaaacacgggattgagataaaatgcacacaactgctttttatgagctgatgttggcacaaattatagcacaaattgcattaactcatttaatgtgctcaatcaccatgggagacaggagttattactttggccatttttcaaatgagaaactacaacacagagaggttaagcatgtacccaaggtcacatagttagaaaggaatctacctgggatatgcctgatgattgacccgagagcttgtgcttagaaaaattcagctatacttcaggcctttgataaattactttaaataaaattcaggttttaaaatgaaaaaaaaaaattatagccatgcatattctttaagtgtcagtcaaggacctataaatattttttaaattttttgaatatttaaaaaaatgttagttttccaagcaaaaggccaagactgtgtgctttgcttaggccattttattttcagacactgaaaatatctgtaaaaatgataatacctcactctggtttgccagagccaattagatttgtcagtatcagtctatatcttattgatcgaaaccgcaggtagtaaaaaacattcgtgtgttttctaagtgttctttcttgttttggattccttgcttaaatcagaatcttactgaactagaaataagaaagtttagactccctccttgtttttaggaatataatgtacctagctgagtggatttctatttttcaaaggcacaataatccagttaaaatgcagtgattctcttaggtactacatagattttacattgtataatcattgcaatcagccaccaaatccataactctcattagaaagcagtgtttcttttaataccattaatttagcctgttttgaagtccttattaagaattcacctagctaaaccatgacacttatatggattcgacaaacttgctctattgcctctagttctgaaaatagattttaattatcatataagattaattaaaagaaaaatgtaattcagtattacctttattttttacatcatgaagcactgagtaacaacatctatatactacgcatattgtgtataaaatcaatgaatgtataatagctgtatggaaaacaggtttaaatctaaaccaatgaaccacagcactaaaaaattaagcaaatgtttattacatcattttggatattgacctttggatatagaaagaaaacattttgaagaagaatctgagtctccacattttatttttagaggagtaggtacttctggacaccatctggtcagcccatggcattcaaaataaaacagtgtttggaatattgaaattaattattaaaatgacaaggagaattttaaatttctaacttgcagacatgggataattttgactatttctggtataaaatgacaggaggcatatctttctggcagagttttgatcttgtgaaacagctgcaacagaaacacatgaatgtttttctaaaaactagatttcaatctccacttcaacttactggatcaacatacataggtaaggctcttcaaacctagaatgcaaggatttaacgatgctgctattaaaaataaagtaactaatttctttcacataaatcattatttgttaattttcaaatggattatacacccacattttatttctttttggaatcaaaaatggatttagggccaagattttagtagaaaagaggtttctttgtagaaaaaaatattgcagaaaaaatactagtaaaaacattggacacaaaaatattagtaaaaacattggatgtgatagaaacagaagtgttaaaagaaatgaagaacaaatcggggcatggaaaatgtatttcttcttaaaaatatttgtaaaagcatgagatgcagctatctttacaattaaattaaatgtgtataaatggagaagactgaactataatccaaatactcagtaattctagtgaaatttgacatatgatagatcaatatttgtgaaaagaatagtttaatcaaaatactaggtcaagtctcttcgcaatttttctttatatagttgaaattaagagggacagcctggagaatattctaagtgtggcggggcctataatcacaataaaatattgatctgctttctcagatgatggcattttggatacacaccactctaagaaattaatcgtacaaaagcaataaatgttcatttgtgagatagtatgtaaaattctgatagaatttggtcacttattgttcatttttaaagtcaaggaataaagaaacagtctatgaagagtttcagataaaaaaccaaatgataggctaaacgtaaagctgagcattagtgttacttgacattctcaggcaacctgcaatgtgttatgaggcccttacttaattttcagttgagataagaaagttaaataaattatcattcatagaagtcattaaaacaaactacacccatgcattttccagccagaattcactgtaaaattttcattatgtgaaaaaaacctgatgaataagaataatgactttttccataagttggcacacttcccaggctagaacacaggagaacctatctaccaaaaactatgtccttctactcccttcaatgaataaactactgttttttttaaaaaaagtttatttctctcacacattaacaaagattagaagtaaacagttcaagatttgcatggcaactctgtgattatcagattatccttctactgtcaaaatgtcatttccaccttctggaccaagatggctgcctgaggtctagtcatcagagctgcagtatgatgaacaggaaaaaataaaggatgaaaaagggagcatcctcgtcctttaatgactctttcacaacgttgcaaacatcaaagagtgaactgatcttaatccttcaaaataaacaagagtcaggaggatttcaatttgaatcccaagtgtattttgggaatattttataagactaaaacaaagtgttttatgttccatgcctcagtttctctagctacaatgaaaatataaaattctgtattattcatcttccttactcaggggctagaggtgataacaagaagagattgatatgcagttcaaatatagacatgtgatagtgatacttcataacataaaaacaatattttatgactaatgggcagaataaatccttcgtctttctggcacaatatgcataacttaaaagaatgtcagagaaaaaaaaacaacattagaatggaagttgttaagaactatttaaatgactttataaccgtgtataaacttacctagaatagggatgcattgaattgttttaaataaaaaattttcttaggtcagaagggaaatcatttttgtgactgtgtgaaaaatacattctcacattggataccattccacaattaatctactgccctttttccttatgcccattatattacgtatgtattcttggcattcaaagactgcacatggtattactctgttttgcctatacttttaacaatatatttcaggacctttttactgtgattcttcaggatatttcaaaaagtattatgaaagatggtagacctagctgctggataactgtatttactgacaataaaaattggtccacttaaattttaaggagataagacaatctcaagtgaaatgaaaatcaataactggtccgtttttatctgacatactagctaagccacatattagagattaaagttagaaattaaaatgaacacaatatggtaatttcttttttggtgttagatgttctttcctccatagaagagatgtgttctagacatttttttgtgtgaaatgaatttatgttaagtgaatcttcctttctgatagaaaattaaaaatttattctgttgattataaaacaagttcttacggacttgacctttgacaaatctcctattggtgcttggtaccagcatgagctaactttatggcccaaagcaacaggacagtgtgctgaggtctgggagcaccctctccagagaatccctaatgtccaaaaattggtcaaaatctaaaatttattttgctgtacaattcacctttttttctggagttgtatttgccttcaacgagtaaggcaagatttcctgcttctgtgatgatggaaggccaataactcctttatgaagtttgattttgctcctgcagggaagatgagtttgagttttttcctgtttctaggatgatagagagcagtcttcagcctgagacccatccctaggtaaatagctgagttagggttttgtcttggctaaggtgtaacaaccagctggtcttaatttctctctaccattagaacattctgcgatcatattgttggggtattttgttgttgttgttgtgtgttctggtctttcttccatcagatttgaccaactctacctgacatggtcaaattcaagtgagaattccaaattataggtaataaagctgctctaatctggtcaaacttcttcgcagcttcaaaagaagaaaaacaaacaaacaaacaaacaaacaagaaacaaacaaaagtgctcggtttctgtgtttgcttcctgtctttaaaataaaatgttattttgtgtacttttcttccaccctatatctccttctccctttgccatctgcagtaccaaaaaaatctgaagaaggcttctagtgacttgaatccctttaaagaattcaaaacaaaggcaccacccactccttttggggtgttctgttttctttgtggagtttcaagagtcataggcagattcttcttaggtctattgctctgttttcttatgtgaaaggaaaatatcttgggcccccaatgttactaagctaaagaaaaaaataaaattcaagcttggaatttcttagggcaaacctgccttacgttctattcaaagtcatttctctgttcactgagataaatgcaaatctgataacttcctttaaaaaggttaatcagaaactcaaaagactgcaactgtttgtctcccacctacctgtgacctggaagccccctccccactttgacttgtcctgcttttgcttccagttgtcctgcctttccgaaccaaacaaatgtttattttacatacgttgattgatatctcatgtctccctaaaatatataaaagcaaggtatgctctgaccaccttggacacatgtcgtcaggacctcctgaggcaatgtcacaggtggaccttctcaaccttggcaaaataaactttctaaattaactgagatctttttttatcccatatatgagcaagtattgtacctagagtggacaagtccctcctcttactttcaggaacaccctactctgtctatagagtagctgttctttcaccactttactttcttaataaacttgcttttgctttgcactgtggactcggcctgaattcttttttgtgcaagattcaagtaccctctcttgggtctggatcaggacccctttctggtaacactgttaaaacacagaaaagtattgatgttgcaccgttcacattacctgaacgtattggtctgttttaaggcatttcttgagattatgcatgaatttttacaattggcttggaagggaggcaattgaagtatgaaagtgaagtgtaagaaaatatatcctggactggtagtgccctggcaactgtctgcttgtgttgagtcctcttctcccaatgtaaagacttgttatttgacattcagaggtatcatcattaggacacattagcaaaatagtgtttttgatattgacaaaagattatcatgatgctaagactagcaaaatattgagaattagctagcttcaacaagcctgaagtgaagttatatatgcatatattagttagcgttgctttcaggaaaatgagtatcaagttagatattagccagttatgaatgtctcattttaactaatgcaagtgatgttactgagttttcaactgaacacatgcagttgatgtatttattaatatttgaaggtagaatttgagactatttgatttcctgaagtttgaaatacgttttcataaatccttattgacaaacatgtatatgtctaaaatatgttttaattagcttaatatttattaatgtaacttttgactatactataaaaagtcaaagggcactaaagcgcttatggagaatagcagtcccatgtgccactcctccagagcaagcacttttaagttttatctcttaattcatgtgtttgcttccacatttttggataatagctttgattgctatgtttgtattttttctttccatataatatgtattgacttccttttttggtagatgagaatttagttatctcactctactttatctctctttcaacattatcaatagaattacatttcaatttttcttaaattaatattcagtggttcatttgtcaggagtatgtaaatactgcccacaattgggccacatagggtgctgtagttacatttgcttttttgtacaactctttgtcatatcccagtgttaactttccatctttttattggcctaattcaatttaatttaaacattattaaatatgttagatctgtaaaagaccttttaatattattttttcaggcattcaaacaaatgaactcattgattcatttcttttctttctttttctctcaagggtttcttttgacattctctggtcttcttgatctcagctggatctggagctctctaagatgaaattgtagctgacaatgactttcctcataaatctataatagcttaatataagctattatgtaagcctaataaagcttataaggggctttctatattaagcagctattctttgtattgcttacccttctcttttcctaatttactacccgattttatgaagcccatatgtggttggcaaaattatttgaaggcctcaaagattcctgactccttattccagttacttatcttgtcccagttattcaatcaaattcaaatctaggtactgctgtgtaaggatatggcagatatatttaagtgtttaaatcagttgatcttaagatagggagattatctgggtgtgtcagggctaattacaagagccctttaaaatcagagccttttctccagctggtcatagaaaagaaagtgagagttatgaagcacaggaagacctcaagtcagtgttactggtttgaagatggagaaggtcgcatgctaaggtatatgggaatgtgggcagcctctaggacatgaaaacagggacattacatctactaccatgaaaatttgatttttgccaacaacctcaataaactggaaagcagattccccctcagagctttcagataagaccagtctttctggcgatattgatttcagtttcataggaccttaatcagagaattcagctaactccagccaaccccagctcagacttctcacctacagaaatttgagataataaatgaatgttcttttaagctgctaaatttgtggtagtttattatgcaacaatatgaaactaacatgacatcattcatcagtttcttgagataatttataatttcttaaatgcttaaacctatatttgatactgtgtttaatatcttagtttttacttgtcaacatattccatatttgaatatcaagatacatctaatggtcacatactaaaatagatttcttaggtgtgtttgaggtgagtacctttttaatcacctaagatatggtgatggagtctgtatagtgttgattcaattaaagtttacatgccatcaaatgtacccaaacttaaacctaggaaaagtggtagcagcatcttgaagatactgtgttatcttttttgtataagtttatctatcatttataaatacctattgtgttctaaacatcatgatataacctgcgaggaaacagcaattagcaagattaagtgtggactctagtgaccagaatatgctttgctttgatgttttaataattatgcaagcttttttcaagaataaggaatgcgtcgtatactcatacctcctttcaaaaagttgagcagtgaaaaaaattaatcaaagaatgtattgttttgactctataatggtaaacaatcaatttatttttttcttactaaatgactttgttggtgaaacgtagcagttgtcatattacgacttctcttgcttcagaaattaatgaaaaacacactagtctcctgaacaagtcatctcagataactttaacaaatctattgaaaataacatcttggtttttattgatattcgaaatagcactggataaataaatgcataaaccttctcagtttcccgttactctaaatggaaaagttgtaaaaccattcctttatattcgccacaatggcagatctgttccatgaatggtaatgcatgttttaaggtattaacaaaattgattatgtaaccctagatatataatggaacagaaggctaatgcttatgccgattctgccttaagtaaaatccatctgtttactactaaggtagcatgcaactcagctttgtttgaatagaacaagatgaatacttgaggctattttctatctgctaagacaaaagtgtagggaaacacatagtaaaacttatattttttaaagacacggttcccagcaaactctaagtatttactgtctctcgaatatgatcaacccagaaaagccacatgataggatacttgcaaatcttcccataaaccccagtcaacaatcatgtgcatacaagtcctggagacactcacagagaagcaactgattattgaattttatgtggaaggaattgagatgaacagttaaagggaaatttatattagattttttcttataggtctgcagatgttttctttttggaccattataaaagcatgaagcatagctttgaaaatgttattttaaaaaatatgtttctgacataatcatttatttctgaagaaaatgctttgttcatattatagttgatattttcaatgagatgttttgattagccttatcaactcttcagtatttgccaaataccctccacccacagtcatgtttcttttgtgtatatagttctattaaagtctggtaatttttgagatcaagatcaaacaatatttcatttgtgaaaccttctataactgctgtgctttcctctgcacttgactatgtttgcttaaacttctaatagagtgattatttcctttttccttgctatgtttttaatgatgtatatttccctcaagtcggtcaaattgcaagctccttgaaaacaatgatatgcatcagaaccagaaccttcatacaagactcacatagtggtgacttcataaatgccctgttgaattgaatcttaaaaagtaatccatgtcatccatcagcaaggaaagaacaattagtatatcttgattgcggatcatttgtttccttaaaattacccagggagaaaaaattggatgaggccaagagtattcctcatagtctgctaaatatagccacaacctagggtttcataggaatagcaagaaaagctcttggacacttgaaagagaaagagaagatacagcaatgcaggactgaggctgataataatcagcaaatttacaaaagacagaaatatttaaaacccgtagattttatctctttgaattactgttttatatttatgtcttatgtattacctaccagaatgttgttcatattcacattatataaatgtgaaaatactttgtgaaattctaaggttacattgaaatgacttctatcattattatattacctaaccaaatattggctttgtaagcatctctttctgacatctcaacaatcaatccccaaacaaccaatttcttttctagtatcctgctctttaaaagcaccaaagtataggtctatactgtttcacaggcagaaggtcccaaagaagttattaaacatcccctcacaggaaagaccctgaagaaatatccctttgaagtcatggcaaacataataattggcttggtaattaaggttttgtattcatgtaacaaagttttcagtaaagcatttattagcatttatcagtacttaaagaggagtactctcagtttcaagaagacctcactattgtcataagatagaattgaaccaatatataatttgcaccgcagtatgtaacaagtctcttttagaaacaagacaacctgcatctcttattttttatatttccgttaaaataatagatgagtcgaaagccacttaagaatttacaagagttatatttacaaacaaattcatacagataacactgttgttttgtgcatttacaaaacacaacacatttatttagtcttccgcatgaaaagccagttaaagtagcttgttaccaaaaatgtgtttcaggagttgcctggctcccttataacttacaaaacttaaccatttgttacctaaactaaaaaagtagatcaataattgttttatttggaggaaagagtagcttccacgttaagaaacgatatctaagagaatatgatcttcacatcagtgctaagctctgtttctgcatctgtgagttaaagtctgttaaaattgcttcattataaatgacattcaatgactgaaggtctacacaagaggagaaaacggagttctaaaaagccactggtacatgctgaagagttcagacaactaagcaatcattttgccaaacaactgttttacctatgccaaatttctatcaggttctcgaggcacaatgaatgcctttttatttttaaaacaatttttattttatttttttaggttccgaggtacatgtgcagaatgtgcaggtttgttacataggtaaacatgtttcatggtcatttgctgcacctatcaacccatcacataggtattaagcccagtatacattagctgttttccctaaaactctctcccccaacagtctcccccaactggcccccgtgtgtggtgtgcccctccctgtgcccatgtgttctcattgctcagctctcacttataagtgagaacatgcagtgtttgcttttctgttcctgtgttagtttgctgagaataatggttttcttgaatttaatacaaaataacttatctcaagagaaaatacggataacctcttttgcccaacactgagaattatgcaacaaagacaaggttgcattctagatgttgcaggaaagtttcaactttgtgatttatgtaattttcagataatacatttcaatttgtgttcagtatatagaactgatgtacctcaacatttctcctatgtttttcttttaactgataagaatgcagaatactcaattcagagcccaattattgtatgtaattatctgctatgattaacaatatcaaagtcattgttttcattttattgattttgttgtaattttatttttgattattctcttttgcattatgtgtaaatttaaaagccacaaatcattttttgaaagaatataggacatcgtaataacttccagaattccttggaaatttcctgaactcttttgtttcttagcctatttaataaaggctgtgtactttcatagaattcacattttgtattttaattttaatcctagaatttggtttctcagacttcaattaatgattcctggagggcagtaagaaaggcagcctgcaatttcacaaaatcattgttctatttgatgatttgttataatcaaataagcatttttttaaaatttatttatgtctttgagatgggggaaaacttataagtagataggcagtgatggaacttaaacattactgtatacatttgaacaaatatatttaattgctagttaatattgttaggttctgtgttcctacccaaacctcacattgaattttaatccccataatccccacatgtcgtgggagggaactggtgggaggtaattgaataatgggggcagtttctcccatgctgttcttgcgacagtgagttctcaccaaatcttatggctttataagtgtgtggcatttgccctgctggcactcactttttgtcctgcagcactgcaaagaggtgacttccgccatgattggaagtttcccaaggcctccccagtcatgcaaaactgtgagtcaattaaacctttttttctgtataaattacccagtctcgggtatttctttatagtagcctgagaatggactaatacagtaaattggtaccgaggtagtggggtgctgtggtaaggatacctgaaaaatgtgaaagccactttggaactgagtaacaggcagagtttgaaatagtttggagggctcagaggaagacagaaaaatgtgggaaagtttggaacttcctagagacttggaggcctcagaaaataggaaggtgtgggaaaggttagaacttcctagagacttgttggctttgaccaaaacgctgatagtgatatggacaatgaagtccaggctgaggtgatctcagatggagatgggaaacttgttgggaactggaataaaggtgattcttgcaatgctttagcaaagaggctggtggcgttttgcctctgccttagagatctgtggaactttgaacttgagagagatgatttagggtatctgggggatgaaatttctaagtggcaaagcattgaagaggaagcagagcacaaatgtttggaaaatgtgcagcccgatgatgggataaaaaagaaaaacccattttctggggagaaattcaagcctgctgcagaaatttgcataagtaatgaggaaccaaatgttaatcaccaaaagggagaatgtctccagggcatgtcagaatccttcacagcagcctctcccattacaggcctggaggcctaggaaggaaaaatggtttcttgggccaggcccagggcccatgctttgtgcagctttgggccaccgtcctccagaccctagaatggtaggttaaccaacagcttgtgctgtgccgtgcaccggaaaagccacagacactcaatgccagccaatgaaagcagccaggaggggggctgtatcctgcaaagccacaggcacggagctgctcaaaaccgtgggagccgaactcttacatcagagtgacctggatgtgagacgtggagtcaaaggagataattttgggactttaaggtttaatgactgacccgctagatttcgaacttgcatggggcctgtaccccctttgttgtggccaatttctcccatttggagcaggtatatttacccaaagcctgtatcccaattgtatctaggaagtaagtaacttgcttttgatttcacaggctcataggcagaagggatttgccttgtctcagataagactttggacttggacatttgggttaatactgaatgagttaagactttgggggattattgggaagtcatgattatgttttgaaatgtgaggacatgagatttgggaggggccaggtgtggaatgatacatttaggctttgtgtccccacccaaatctcatcttgaattatagtctccataatccccaagtgtcctgagagtgacccagtgggatgtaattgaatcatggggacggtttcccctttgctgttttcgtgatagtgaggagtgagttctcatgagatccgatggttttataagcgtgtgacatatcccctgctggaactcattttttctcctgttgccttgtgaagaggtgccttcagctatgattgtaagttttctgaggcctccccagtcatgaggaactgtgattcaattaaacctcttttcttaataaattacccagtctcaggtatttctttatagcagcatgagaacacactaatatgctagcttaaattagcaaaccatttaaaatcaactaccccaatgtggtgaatcatacctttagcccagatatttcctctgaataccaaggacatgtttcagtgggcctattcaaaatctccacttggatgtgtccagggcttcacatgcttaaactcctggtagatgctattatcatgatcctctttcacatgtagtactccaacagtctcctaagtattctaccttccaatttattatctctgcagtaacaggactgcctttttttcaaattgcaaatctaatcaaacctcatcatcatctacaatcttctacaattaaataacttcacatcactctgtggttaaaagaacaaaaataaaaactttggatcatgaccttcaagtacctgtggcttccccttaccactttagcttcatcttcaactgtttccccatgatttctactctagtcatgctggccttctcatatgcccttgtacttggaaagttcctacctaccatgggttctggaatagtcttctcttcctctttctcttcttattcattcttactttatagatatcacctccatcagcacagtcccagaacttcaccttccctgaattccaagtctaggtcaaaaccactcatgacatcaggtccttctctttgtggttattttattaatatctattgcttcttatgagattttaagtaataatgtaaggaattgtgtctattttttctaaaagttgtatctaatttccaagcctaatgcttggtttatagtaggtattcaatataacattcattggatgaatgaattggggttaatagaaagatgtcaatcattctaaatgaagtcattctaaatgtaacaatcattctaaataaaaaaaattatttagtaatgatgtttaatgaaatcttattactttatttctaaaacctagctagtaaaaaattgacactaaaatgaagagaaaaaacatgttttagaaatatgggtttaaaccaatgatttgaataaagcactggggtaagcaagaaagggttttggataagtccaggataacatgacaagtgctaggtaatttggagatggaggaattctaaatcaaactccacctctttataactctctggaggctcagtttctctattgatgcttacagtgaaacagcatcctttaatagctatattgaatttttaaaccattgagtaatttgtagcagctttctatacaagttagtggtctcagctgtcagtggataagacaagttctactagcttctgtcttaaaacataattttagaaatgaaaattctggaaactgtgtttgatgaatgtaaatatagcctagctgaaactctaagacattggaactctgattctccttgaagagaaattgccatttgctacagagaataaaatacatggagattaaaatatgctgtgctggtgattttaaaaagccatcaagagaattaagttaaaaatcaaagatgaaactgatgaaagccagacccctgtctcattgggtactcctctctagggtagttaagatacctggatggccaaaagaaaaagttacataggctatgttcagagaatgtgaaaacagtatttctgaataataggatctttacaatttttatttcattagtgaaagtctttcattatttcccagtattctgctttcatctataattttccctcagatggccacctacattaaataaaacaaatggtactatagtgtcactgactgagaattgtgaagaatttggggatctagagttggaagaactctaatccaatttagtcaacatcagtgtacaaatatgcacattgaattagattatggttgtcctccaggtggtagcatttaacctctgaaggaggggtaaaatgtgattttaaatgttcaagtattctgggacttcttaaaggctgtgagatattgtgaagtttagttatattaataaagatattggtaatgcatttgcaactatgattttgtagaagaaaccttgcagaaaaaaagatactaagtaaaatgtagatatgaagtttagatgcaattacaaaaattgctcatattaaaatattattgtattaataatgcacccttgtaaagcatggttttaaatgttgaagtaaaacaaattactttttatcatatgaaatagtttcatttttaattgattcctttacactgaaataaatacagcaattaaattacacttaaagatatgacataataaaaatatttcttgcctttagtttgatacgtaggtatagatggtttttaaccttttaaatagtgttcacctttctaactcttgctttggcaaatatggaaaatattaggaggaaatgcctttgagaattactattatctagcgtgaattttaggacacggttagtaatagaactgagcatttaattataagatagctggtgatggtaagacacgagaatgaaaaaaataaccattaatataattatttccaaaatatagagatcattaaagtttagaatctattaataagcatttttactcaaacttcaaatcttatattaattaattttgcctttattctagctagaatagtgtaatacagcagaccatttctgaataataaaatgtggcataaatgaggtgctgccacagcacgcattggattaacagaggataatttgggaccctgacatcttaagccaggataacagacgcaggctacatttaccttaagtggagatgaaaacactaatcattatagccatttgctgttaacagatactttacagtatttattgcttttctccaagaatggcttcataacaaacattataaacacgttgcaggcccacgggaaagatttgcagtcaaatgctgtctcacgctaaattagattaacagtttcttactcgtctctaggccaccccccactttgtatatataccagctcatctcatgtccttagcaaataccgtttatttttacactcagaattataatacatatgccaagatcaacaaatagagagaaagtgagccataggttcctccccccagacatatgataagtattaataattgagtacaacactcctttccactgatctttatctgatcttcatgccaaaacctttctcagtgtagtattccaggaagctactaacaagtgatgcaacctcatatgttgaaacctctttgctattgtgggtctatgccagtactttcaagtctctttgactttatagcacatgtaggtcatgaaaaatgtggacaatactttgcattaacagataaggctgcccataactagagatcatgaatctgtgggttagagaccacccagaatgctcatgagatacgatagctcagaacccacttgctgagctctgactgatcaaggtattggcacagtctatccaaaagtagaaacaacactggcagggcaggatctgacatcaagtaaggttttctttattctgtatttgctgtgagtgttattagctgtcaagctgtcttcataattgtaagacagttcacaacatcataaaaaacttattttcccaagccatggattaggtctttggattcaattaatctgatacaggtatgacaaagcattctcttttcaaacagtttatcttagagatacctgcagaatttctattagcatatatttccgtctactctagtgctaatgatcccattatctggctatgtgttactgtaattgaaattagctacagttatatccatcatcttagccctcatagtcacagataaacaatgtggatttatagcaattctaccttggcattgaaaaggtatccctttcagtttctgccttcaggtaaaatgtatactatgtggcttactatttctgatgtgttgattctatacccttttgaaacattttttttttgaaactagtattttggatctgatattaaaattcgttctgacctcaaattcatttgcattacagtgtaatatttcctccgtaatttatgtcatatatgatctagaaggggaggtatgtattaaaataattatctcattcaatgcagataatagctttaaaatatatcgacatgcttttccttataattttttgtattcagcttgagctcccctcccctgacaaagagccacccacttatttcctgaaagaagggggtgggtgggtatattaagattattataacaagaaagcaaagacagatagtttggtttttagattttggttcccaaaacagggcacagtggtcagatgtgggtatattggcttcttcctctgtatggacacactacagaggagagtttggcagtattctcagagcagggaaagtctgacagtagcctggggaaatggaaataatcataaagattccccacattagcctaactctggagcgacaaggtgccacacaggcattaagttaggaacgcctgagaaagacgtcttgaatctgcatttaagggcagactctaaacaaccctattcattacagattgataggaagaaagtagccaagatatttttaccagacccctaagggttgggaaaaccagtaaatcaaaattagtctgggactgatgaaaagaagccacaaaatacagagatctcacagtcataggccatggcaggaacatgaacttcagcaacatatatctgcgtggaggacaaaattttgtaagaggtgcagccgcatttcagtgtgcgctgtcacaggacacgaacagagacacctcactgaactggagaccagtagatattcagagcacattctgcagttcacaggattcttccctaagatactaactttgaaatagagaatatggcaggcctactgaaagcaggaaagagcatcctgataggaaatttgaatgttgtattaaatccgaagtgtcaggtctatgtgaaacaaacaccagataaaaacaaaataagacaaaaactatttcaacttgaataaaacaaatactttaagaaaaaaatcaattgagctataatttacataccaccaaatgtattcattttcagtgtacgattcaatcatttttagtaaatttacagagctgtacagcccttaccaattccgatgatgaggaggggtggaatgggggcagggaaattaacaattaaaagtaactcacttttacaacatttcaatcactttattatacatacgcatacagttatgcatatatacacagattatatttatgaacatttatatatatataaacataatgaacctcttctataaaaaagtgtttatttttcattattttatcaattatttatataattcattcatttaatgatttttatattgagaaatatggagaacacaaagtagaataaaattgtctttctgtttaagaatttcatagcttggtgtgaaagatagtcacgaaaacaaataatgacagtacttgatgaaaagttttatgacagatgtattccctggaattatttcatctctttcatactccttacaaccctatgaaataagccaagcatatgaatatctacattatatagataaagactctgtagaccacagcagttatagtagcaaacatagtgagaggaaaaaacagaagttaattctagattttttgatacttaaaacattcacatatatttggccttaaagacagtagattttctctaccgaaatgtaacccagtttttataaatgttactgaggcatgctttttttttatttttgtggaatttgttattatttttcaacctacaataatctattcaatacccactctgccaaataccgtgctagccatgtggcgcctccaggattagaagttcctttgctgttatcagttcttatagagtgatgttgaattgtaggaatgtgagaatttggcctccttactgataagaaagactattaggaaactttccaacctgttggaggcaaatgagcgttaatgcaaaagttgacttagaaaaagctttattctaattccagcttggccatattctagttgcgtgaatttcagcaatttgctttgtctctctaagccgatttttgctttacaatggggatacaaataccaacctaacaggtgaaaagtaaatgttatataataaaagtgctctttatagtaccttcctcataggaggtacctcttgattatttttaatgaatgcattagtacacctaaatcacctgcatatatttctgaaccctctaagcggtatattgtgccttgattttttaaaaacataataataacctgtaatcctagcactttgggaggcttaggcccagctattcaggaggcttaggtgggaagagcacctgagcccagagaggttgaggctgcagtgagccatgattgcaccactgaactccggccttggtgacagagtgagaccttgtctcaaaaaataaaaatacaagtataaaataatgatgcaatccctgccttctggtagcttacatttgataaattaagctgaaaagaattgtgggtatgcaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaaaaaaaaaaaaaaaaaaaaaaaagaattgtgggtatgaaataggaaacaagcagacaagttacatgagtcacttagaacttgagttcttcttataatatgggttcaaattacctgttgccaggtttaaggtgaatcgtttaccatactgttttattttccatggtctaaactgaaatgtatgcactaaggtcagagaaccaaatattagctttaattacacaatagatatattagagaatgccacagactttttactgttttcctacaagtctaaaccttggcccctacatgtggggataattgggtctgcaatctagttgcttgcataatcctagcttgccttacagtgtagtgagagctccaggtaaagagcacaagtgagcttcaacatttattcattttcccctcgcactggggaaactcgcaccaaggggttagagtcagattcttgccatctaacaaatcagatgaatcactcctgctcacatagggagaagcttgtgagagatagaggaagagcaacaatttctacctacagaaattattttacagcctgccattaggtgtccaaggagagagagagaaagtttcactctacacatctgaggtagaagtttgataagaattaaatgagggtgtatataaaacaccgagaaaactgccgcccctatattacctgctcagtcaaaggtaatatactctgatgtgtacacaatctacatttgcaggaagaatcctgagacccacagcaaatcagcaatgctcctcatgggagaactccaaatcataccccatctctgactcttaggacctttgataagatggttatcttatcaaagataagaaggggaagaaggggttgctgtgggctgtaggaactgtgagggcctcagagaagtcatattttgaactggtgagtcaaaccttgaggagaatgttaacataaagagcttctcctgtctccgtcaagagacataacctctccagtctccgagctaattcaggggcttgaacccatggcctttggtcaacttcgagctctaatatccagaggtggtatttgtattgggttacctgacaatgactggactaacttcctcctccgacacacaccagcaggtgactgggcctccctaaacacctcatgattcttcttccacagcctggcttttgagtaggacttattccacaactgaacagttggaattgcttctgatcatatgtgctgaactgcttagcatttatttaattctcatttcttactgtgtccttaaatctctcgattcttaactagaaaagtggaagtcaagagggagcactactttgattgtctccacccatttcaaaatgtcaggaggtaataaagggggctgtctgaaacctgaggagcttctgtactgtttctgactgagaagtagggatcagagctgagtgtcaggtatgaaattattttcagtctctggcttgctccagcctccaagttctgttcacgtcatgccttctcagactattaacagaaggaaaagctgaggttgtttttattgttctttgttttgtttttttaaaataaagtaaaaacagaatgatcagaacataacactgctgctgaatgcacaaggaaccatcttatcaaaggtcctaagagtcagggatggggtatgatttggagttctcccatgaggagcattgctgatttgctgtgggtctcaggattcttcctgcaaatgtagattgtgtaaacatcagagtattggctgccacagtcagagggaatgtaggcatttcaaagagttttcagtttatgcgtcagcaattgctgaaaactcacccttcaaagtacagatattactaatgccctgtttctgctcttaattgctaattatacaatctgtgtaaatgcaagatatgtgactcctccagctctgcaaatgtctttgcagctgcctgtacactcaaattaaagcccaatgcagctgtcctagaggtagttttatgtgattccctgaatggacaaattctattttgaatgctgttaggagtctctccctgcaccactcaaaagtcacttacattacggttgctttcttcctgttcagcatgtcttctcttcctggatgaagtgagaaattgccattttgctgttccttgctcacttaaatgtgagttacacaagcctttttaaaatttcatttcctctcaggaaatgttttaaaatatataatttatttcttttggtacccatccagaaaagtatatttagctctttttaatgcattgcctatatagaatgtgatttttttcttgagagccttatttcattgagtacaaacctccctttatatttctagcacattaatgttataaaaattagtactttcccgtaccctgaggaatccaggtgtcagcaagtgttaccaaaacttgggcatatgattaattggcttgagcccggatgacacaccctgtggtagcctaacacactcttcaagacgttcatcagttcacggagatattttaatgatcaccactgacatgggaatcttgctccgatgagtcctgtctctgttccctcatagtatcaattcaaatacataacacagcttctctcttggttttcataaaacatgccacaaactctttggaaatgtagtcgagtttattcaaggtttgtgaaggatagagactgaggaaagaatttgcattttcaaagtaccaaaaagcttaatttcagtattagatatctgtattctaaaaacgctcaccaaccacccgtctctggagtatttgcacagacactttccttccatgcagtttctaacatcacaccatcatgccatactggctactttctcttctcttcctcttcccacttctcataccctccatccagtactgcatggagaaatccaaattctttgcctcatgttaggcagatgtgtttgtctctctcagccttgattctcaagcctgcatatccaaacccatacagctacacagacgtgaaaaatgaatttctaagtagaaatagacgggattcatctttttagaggagacttgtaggtacaaagaattatttttctttcactgttatacttgcatcaactgtttgttgtgagttcttttattcattcaacaaatacagctgtcctctcattctctgtatccactgatttcgcatctttggatacaattaaccacaaattgaaaatattttaaaaccccaacaaaatagcaattacaacataaaaattatacagataataaatgatagagtacaataactatttgaatagcatttacgttgtgttagacatcatacgtaatctagagatgattaaagtatacaggagaatgtgtgcaggttatttgcaaatactataccatttcatataagggacttgagcattcctggcttttgatatccacagggatcctagaaacactctcccatggataatgagagatgattgtattcttttaatgcctattatgtagcaaatttcaagttagcacttgttctgggataaatttgtacctgttaataggagacagtataaacatagtagaaggaagccttagacacagaggaacttgattctagttctgattgattcatgctttcactttttctttccaaaaatggttgatgtaacctactctgtttcagcaagatattagatacagggaatgctgaaattatttagagcccctactctcaaacattgtagaatagagtaggaaagacagatgtatatgctggaccgtaaactgagcaatctgacctttatacaaatcaaggttgaatgtgtctttttttttcagagcctgtgtttacttttgactagcgaagagctttcagaaaattaatgttttctcaaatgaaatcgattggcagaaatcagagggatagaggaaatttattcaatgcagagttgacttaaactgcggtgaatgtttactttctggggtcaaaaatgcatgtaccggtttcttttttgttaacatttaatatttcctgttattaataaggaaatgttgcacctgaagtaaattaaatcaagatggaatgtataatttctttgaaaacaataaaattgttattgcagatgttattaaactattagtcaatgtaattttgtcaggattatgtactattgattaggaaataacctgatgaatcatttggaaggatgctttttatttttagctttgactaacaggagtgtttgacagaagcaagttaaaatagtgtgttatactgctacagctatgtgaatttacattaaatgctttatttcagtattttagtatttgctgttaataaagaaaattaggaatctgaactcattttagttggcctttgaacactttgagtttatgagtttgaaaacaacttcaaattaaagatacattgtgatttcactggggaactttgggtctttaaaaattcatctgatggagcatggtgcagttaggccaagtttgcaaagacatatgaatctggatcatatggaccaaaacatttgcttctcaagtaaaatctagctagtcccttttttccatgttacatatgtctgaatttaaattccctatgtcttccatctcgaagataccaggttgttttttttttagctctgaattgtttccacccattatctttttaaagaattcttcgattgtatttcccttttattataaaagcactgttttataacttttacataccaatctgtctccagtaccaatactacctcttttatgaacaacctttgtttagctgtcttattcacatatgtacctatgtgcctttgcatattttcaactctcaataaatgctttttgaatagaattcccatagctaattaaaagtgtcagctgttaaaatggacttcacacttctttctcttgaggtgaacaatgcacactggggtctgagaaggtggtttcttaatctcttactcttagcaggatacccaccttttcttaagtgcattctaagtttctggagatatataggattgcagtccagaagctgtgctgtaactaccaattctccttagatttgagtgaggttaacagagtaaaaacatgatgttttgtgaatgcgccttctgtatatatggcacctttctttatcttcagataggatcagtgttagtagatatgggttttctgtgaagataattaaaagccatataatttcacaggtatatatttggagaggttttaaagaccacatgtccaaatatataagcttttgtttccacaaagtctggatccactccttgtgattagccccattttacagttgagagacattaaaagattatgactgatccagaattccagagcaatatattgagaaaagtagaaatagtaccctgattgacgcttcttagtttctaggagagagaaaattacatgaaccctttacaaaaagaagacagaagataaaattcagaatttatatcaaattatttggctctgagtcaaatttcatctgcaagaatattatgttccaggtgtttgccattgggacaatttaatgtgtttaattagaaaatatattttaaaatattactaggtcgctcagctgtcaaaattatgtaaataaaatggtaagtgaaaataattataaaaatatttaaatgtccttatatggctttttaggaaatgtgcttcattttctttctacacaacccaaatgtccaacagtgatagactggattaagaaaatgtggcacatatacaccatggaatactatgcagccataaaaaatgatgagttcatgtcctttgtagggacatggataaagttggaaaccatcattctcagcaaactatcacaaggacaaaaaaccaaacaccgcatgttctcactcataggtgggaactgaacaatgagaacacgtggacacaggaaggggaatatcacacactggggactgttgtggggttggggaagggaggagggatagcattgggagatatacctaatgctaaatgatgagttgatgggtgcagcacaccaacatggcacatgtatacatatgtaacaaacctgcatgttgtgcacatgtaccctaaaacttaaaagtataataataataaaaaaatacatttttcctgggttcttcgggaatgtgattgttatagttacaaatgtatgcatatttttaaagaaaataaggttgagtttcagcctaggcaaactgctgaacccaaaaatcactgtgagaattttgattagtattctgtagatggttttcagtctatttttgatattttagcttagacttttgaagacagttgagaaagcattttttaacaacgagaaattcattattcctaaattaaaagataaagagtggagagtagatgtatggttgacattttacaaatcaaatactttagagttaataatttctacctgacactctatgtaacacagcattcagttgatggtaatttgttatgtttactgatcactattaagctattaaatgtttttaaaattaattattttattattttctgccatgctaattgcttaaagaagaagagcagtgattggagtggtgaaataaaacaaaataaaacacagacagtttattgtcataatatttctaaattggaagtaagtatagccgaatgcctcttatacaaggagtcagaagatctgcagttgttttcacatttaaaaacctcagcatccttgcacaaatcacgttgcttttctgacttttcaattcttcatctataagaataaatatatattactcttaccttatcttcatagcttttgttaatatcaaatgagtaatggaaatgaataacctatacaattgtaaattaataatgatgtggttgaagacgattcaaggaaattttaacagtctgtgtagtgatccaaatttggctattctaaacaattttctaatatttaaattgtaagccatgcacatttcatgatttaaatatcaatcatatgtccacttactcagctaatatttatttagcacttactgtggaccaggcaccatgcaaagctttaggggctccatggcccacctacaccgcacatgatcatcttctagtggaaagagctggagagtaacatgtgtgactctcatattatctattttgctagaaaagagtatgaacatatatgtatacttttatatcttattgtaatatcctctaactgaaaaatttatccagtagtttcttctctattttgtatacaggtctttggcctcacatatgtaggacatggccccaggagtttaataatcactcaactgagtatgttaattaggaattaagtaattgtattaacaattttttgattgaaactagattgagagcaaaaattatataactatgtgagatcaccaaacacccagagaagtcctgggaataacagtagttcagtaaatgtggaatttgcattttaaaaaggaaacttgtctgaggcaggcggatcacctaaggttgggagttggggaccagcctgaccaacatggggaaaccctgtctctactaaaaatacaaaattagcgaggcatggtggcgcatgcctgtaatcccaggtactcaggaggctgtggcaggagaatcgcttcaatgcaggaggtggaggttgcagtgagccaagattgcaccattgcactccagcctgggcaacaagagcaaaactccgtctcaaaaaaaataaaataaactaaataaaaaggaaacttgtttatataatgaagtacttagaccctgttatttttgccctgatatattttacttaaaggaactttctaaatatatacgtgtgtgtgtgtgtatatatatatatatgtatattatatatattgtatatatatgtatattatatatattgtatatataatgtatattatatatattatatatatatgtatattatatatattgtatatatatgtatattatatatattgtatatatgtatatgtatatatgtatgtgtatatatatacacatatacacatatatgtgtatgtatatatatgtgtgtatatacgtatatatacatatatacaatttttgtatatatacatatatacacatatatatgtgtatgtgtatatatatacacatatatgtgtgtgtatatacacatatatatgtgtgtgtatatatatacacatatatatgtgcgtgtatatatatacacatatatatgtgtgtatatatatatatctcccttttcaaccatattccactatctccaaacagtatgtttaatatagtcacttgttctatcgagatccccactgttttcttgttacagcaatgtacataactctatgtgatatggagcacagaaatttataatgcttgttttcagtaaaagtggagaaagaagccattttagggtatacatagcactaatcacaatgcctaaataacttcataataaataacatataaagaagaatgaaaaggtagaagaaaagaaggaagtgagggaggaagggagggaaagagagaaaggcaaactacagtggtgtgtacagaggttcattaaatgatagaaaggtaaacagtgctccctactaaatcttttcattctagtctcccaaaatattagtgtggcatcagccaatttcatgtctaaaaaactgtctcagtttattactaatcacaccaagaagcaagtgtgttaataatttataatctatcatcgagacaagcttttactgtttctaaattatttaaaatgatctgttttctttgtctgcctgtttatttaatcaatttaattcttatatattgttctatttaaaacttcactagttgacatttagtcatttgctgtcccaagtttgagttgaaggatggaatttttaatgagatcctttcaatcattcaacaaatatttttatcacctatacttctggatacttagcatatagcagtggaataaaacggaggaaaaaaaaaactattattgtcctcattgaagttatttactagtaggagaagtgatatggtttggatctgtgtcactgtgcaaatctcatgtcaaattgtaatacccagtgttggaggtggggcccggtgggggtgattaaataatgggggtggattttgcccttggtgctgttctagtgatagtgagtgagttcttatgagatctggtcatttaaaagtgtgttgcagcttccccctcgtctctctttctcctgctccagtcacgcgaagtggctcactccctttatgccttctaccatgactggaagcttcttgaggcctccccagaatcagaagccacaatgcttcctgtacaacctgcagaaccatgagccaattaaacctcttttctttataaatgacccagtctcaagaatgtctttatagcagtgcaagaatggactaatacagggagatgtacccaacggatgaacgagtgaaatatttaaaatgtcagaagaaaataaatactatgcatacagatgaacaaagtaaggaagatagcctgtgacaatggagtgattttattttaagtagggtggccaaaggacgcttatttgatttaatatttgagtagtgacttgacgaaagtgacaaactgacacatgcaaatatctaaggtaaaaggttacaggtggaggacacaacaatgactaaggctccaaggtgaaaatgtacttggaatattgaggtaagtcaaggagtccagtccagctggagctcagtaagcaaaaaggaaaaggtaggaggtaaagtcaggaagtcagaaaaaaaattatatatatataggttattataaagacattgtcttctactgaatgaaagtggaagccattgaagggtttggaatataggaatgatagaatctgacaggatctgacttttgttttcagagacaaggtctcactgtgtttcccaggctggaatgaagtggtgtgatcataggtcactgtaatcttgaactcctgggctcaagccattctcctgccttggtatcccaaagctctgggattataggtatgagtcaccatgcctggccagatcttactttttaatgtaatgattctgggatttcattcaagatagactaaagggtggtaaagactgaagtaaggagactagtgaagaggctatagcaagacatggtggtgacttacaccagtatcataactgcagaagtaatgagaagaatttcctaacactcattcttgtatatgagacacacacaatgtctcgaagatgacttaaagagttttgccttgaggaaatgaaaaaatgtagttgccatttaataaaatatgtaaaatttcaggaggaataattttctggcattttggaatggaaatcaggagttggtagcagtcatgctaatgtttggatgtttacaatttcataatgtagtctctattaaccttacaagtcctgtggtattgaacataaatttctattatcctttagaagcttcaaagcactaatattttataaccattaaatttttacttgaaacattttggatcaaatttcttattgtttttgtttttctacttttcacatagaactcaaaaaatggacttttaaccttggtagtaatcagagggagtcttgaatttgaagtgatgctaaacacccacacttcatttgcatttatttactgcctttatttttgcaatttttaatttcataaagtgtctcaggacttcctataaaggtgtacgtataaaaatagtctcatataatcacaccttgcagagataactattgttttcattcatattctttcttatcactccataatccattcacaactcacacttgtgtatttattgtgagaatgttatataccaggaactgtactaaatgctttacacggattggctagtttaagtcatacaacagccttttatcagtcatgttattacttgcagataatgaaaacaaaccacgtagtttacacattaaaaaaagtattaaagaatatcaacttaaagatttcccagaaattgcaaatcatgctgaggtgctgtacagatggacaatgtccaagactgcaggacatatttggtctgatagaaaggtcacaattgcttctgcgattcacagacaatgcatgtgacaccaccaattctcctagcactggacactggatattacctctgaaatgtttgcatctgctttccatggacacctatacatgataaattttcttacaatagagtaagtgtgttcaaattctgggaaaccaaaaatactactggaatggtccacgtcttagactgcccaataccagtgtattaatatgtactcagtaatagagactcagataataaaaccaacccctgataagcaggcaaataggaaagcaagactaatttattgtctctgcaaaagagggtcatccaaatagttattatttttatgttgagctgcagctctcatcagcaggtgattgtgattcttctataatttcattacaatttacctcaagggactaaattgggaaggtcaccaccatcaatgaactcctttttaaaaaattactagggaaaagagagaggagaaacacacaaacacacacacacaatagttagcatagccaatcatatacaagaccctgcacagcatccatgctggcaagggtggtggcagttacctccagtattcaaaagcatcaaaaatacatagttattaggttattaaacagaaataccaaaatttatgataagcactgccgaggagtgggttatatttctagctctgaaatctaggatccatctcttacgtgttctgtgtgctggggaaagttgcttaacctcactagccttcagtttcttcatctctaaaatagagacatcaataatatacctatctgatagaactattattgtaataatatgaaataatgcatgtgtcttctattcaaatgtaacttgtttgtgaattaaattacactatgggtacatctgattatctgactggccctgaagaggaccatgtttggctgctcttgcgagtaaatcagtaactcaacagtggcagtagccaaatgagtgataatgaggtgaagtttcaacagcagaggttgcaatactttacgtgttgtatataactcaggattctttcagcaaaagaattgttatgactataaaaactaagaaaacaaatttaaaaatagttttctagtggaaaaatgcaaagatatactttatatctgttttgtttttgtagcatatataatagagaagtagtgtgggaaaggtcacacattgatacagcagaagcattggaataataattatgtctagcaattagcaaacatctatcatagttcagatactatactaagcactttacatatataatttcgtgtaatcaacatagcaatttttgaaaattgtggaattgaatattagagaatataagtaccttgccctaaagtacacaatttaaaatggccatctaacttctatattatcgtggtaaatcaggcacttaatgatcagatatgtaatatctactttctgccatagtgcattcctataaactgcaagacaaagcaaataattgtaaaatgaatggtattttcacaaagaaacaatgccattattgaaaattgtgttcttaaccaataatatgacattgaagacatcatgtatatataatcaagaatatgtcataagaacaaagaaaccgtgaccataaaatgtgctaaatctgatagatattaattaattatgtatttgatgagtaataatgctgcttctcttttttgaacttaggatcttgaggaatattttcagtggcttttatctctaagaaaactctcaagtggggaaaaaaagcaacttcaaagctttcttctttcttgataaatgtcctttacttttgtagtcatttagaactactccactgactatctttttaagttgctatgatagcatctaatattggggaaaaaaagaaaaaaaaaagctttgaatgtagtaatgtagaagacctaatttctaggttcgtctctgctggaaattacctacaacgcccaagcagtagtgcttcttttctgttcctgactttctccatttctacgaagacactagatttggtgaactctaaaggctctttcagggatagaactttctagaaactggtatagagtacccagtccttggatactgatctaagttgttggagagcagacgttttctcagtctggttctgttgactattgattcttatttgtctgttcttaccacaggatcaaatcatgaagggaatctcttccaggttatatgacttgctttggtcataactagtgtttacagacacatagtatgatatgtcatagtaaaataagaaggaatctagaagttttgaattcaaatcctgtttcttcatttactgagtgaccttcaactaagtcacttaacctccttaaacctagaatttcccattaataaaacagaggggatagttcttttcctacagggtaatgataaaaattatgtaaataatgtatgaaaacatcttgtgtgtatctatctccttatgatagttataggctgatgtagaaagtcaaacccacgggcatcttgataatttgttagaaagccactccctaatgggacaatgtgcctagacaaaagagtttggaagtaaggtagagatgctaattagctgtcaactgattttgaactgatcaacataacaaagcttaaatagactctattgctattatcagtgcctgttaattcactcagagtatgtgagcaaactataaacctgcaaaggattacagaggatgcttagcgcagtgaagccctgtactgaatgaacaaataagcccccagggaagcttttaaaaattaccagtttctagagccggtccctggacattatgattcaatagatgaagtgtggtggctaggagtttgcatgttaaagaatcttcgtagaatatcaatgaacagccaagattgagaacacctgaactgatcagattcctcattttacaagtgaggagtatctggcagagggaggaagattgagatcccaaagcaggaacttgaaaaaaagttctcctgatacttaatcctttgttctttccataatatcacatggcaaaagacagatagtagagtcagtggtatttcctgcaagccaggaccattgtatatggtatcctggctgtctatgctgaagtcaggtttatgttctcatgcacataatgtgagccatggagtgctggggccatttgtcagagacaaccttctacaatgtcacattaccaggttgtcaatagtgtacactcacctgaggtaggctgccacattaaaatgggacacaatgacaggggagaatctagatgtaaaattgaaagagtcagaaactgcccacagtcagaggaagaaataagaagtggaagcctggaggcattttctgatattgccttggtgtttgattgtgattctgtttctaggcatagcaaaaggaaacaagactgacttgatggtcaaggtgatgtaagtagatcagctggcttccccaatttttttgaaaccaaaaaagtaggcccggcacggtggctcacgcctgtaatcccagcactttgggaggctgaggcgggcggatcacaaggtcagtagtttgagaccagcctggtcaacatgatgaagccccgtctctactaaaaatgcaaaaaattagctgggcgtggtggcgtgcacctgtagtcccagctactcaggaggctgaggcagaagaattgcttgaacccgggaggcggaggtttcagtgaaccaagatcgagccactgctctccagcctgggcaacagagctagacttcgtctcaaaaaaaaaaaaaaaaaaaaaaaccaaaaaagtaataggtttatatgtatagtaactaacatattataaagttcattaccagaaagtttatatcttggtcaaatatatttacctaaaaagtggaatatgaatattaagatacagtattaataaagtcattaaaactcatgatttgagagaaactagatctgtagttagaggcaacaacagtttattgcatggaaaaatctttccaatttttagttctggttaaaatccttctggggtagcggctttttgtttctaactttaaaaagttcccatacacaatcaattgtactattttattcattttgaaatgtttgacagtggaaggactgggaattgaaagactttgattgcaatcctgacttgccgtggaccaatgtcatgaccttgcagaagttccttttccctagactggtccccattgtactcactggaaagacatgatctcaaagggctcttcaactctaagagtcagtaagagcaaaggtttgggcagagatgaaaataagatagcagggtgcatctgggaggtggaggatggaattgaatctgatcccaatgcatctgtggggatcagagctaaaatcaataatgtatgctgttgtttctttttatctttttttcttttttttctcctaatgtctttccccatcttttcctgcctttttaatattatgtctcctaactctagctttaactcctgaattatattaggattttgttaaagttcatacattttaagcaaagagatgtagaaaattgttaaggcttaaaatgaatttcaacactcagtaattgcatatcctctgcttcctactggaagagaaagaaacttttcgtggactggagggcaggagaatgagaaaaaatgtgttttcttcaaatttctatgaaaatgtgacagcattcatagggagacaaaaaaaataaattagaaaacctgataatccttctggagcagtgctttttctttcatgaaaggcattgtgaatcttcacccatagaaacattttgagcacaattgaatgcatttgtaatttttgaatcctatatttgaaaaacatttgaaagccaaagtactaaaatctaaagaaaatgcttttctatcggcctcctatcatatttttatactgtgatagttacataacttgaaacatggtgtttttaatgtagtattctcaagcaattgtttagggaacaaagactcaccgtatggtacactggaaaatacagcagaaattttgaaatcagaacaaactggactgcaatctccctcccacttcataggtataacaattttggaaaatcactaagctcctagttttcttacttgcttctcgtgaaggtagagtgtaatatttgtacaagctctttatgaacaatacaggttacaagagaaagggaatgtgttgccagccaatcagctcctcaaatgtgctttcattgggtggcaacatctctaatgtgaaattgatattatctatatgtgattactaagatcatgacggaggtgattcttttgaagtatcctcagtgcagggtttggcacagactagttactcaatacatatattctagccttttctttttttgcttacacaacgttaacttatgggtataatagtttaattatcacatgatcacacttgagttgttattcagaataattttgtcctcagcaaataatcagaacattaataggcaatgcagatagagagtttatgagtgaatgacagcaactggcccaacttcttcagcactaggtttctaataattcaagcctgcagattgtgctgtatttttattcatttgcactgcaaagttttttttttctgttaaatccttgttatttggccctgcatcatttcagtaaaataaacttggctccatcaaattcattaggcaagctatgatgtgggaaaagtcaaaatttatcttccctgaagctactttcagacagtaccttaagctgggcattttaaagtggtgtcagataaacttggcagccgtttctttccacagatattcttagttgaagcttttggtctcttcttcactcatgggatggttcctcttgccctggttgcagaatagcgttcgagcagtgaggattctcagcttttctgttttacagccctagagacttggctgctgcagctgggtatcaagcaatgattttcacatgcctttttcatcactttttttctaggagaagattgcttttgacattcatttttaagttacatgtcgttttccaagagtatatctctcacaaaagctttagaatgccagtaataaatgtattagtagctaagaagctcagtctggcaactaccttgtctgctttaagtcagtgtgaaatacttccaataatttaactcttcttaaacaatcacttgatgtaatatttaaatctaaacattaaaatcttctgtggtttttgatctgtattagttcagtactacatagattaaatatttgatatctgtacctgaatttgatctatactcagccagcaggagaaatcgaagggagcattagatactcgtttatttatttattttaatttattctgaaaaatgattaacttacttatttgtcagaattgattgtttaaatgaattgacttgattgtactcattttttggtgttcggttagaataccctcaattgacagagtcactggtccagcagcttacaagtataatcaaaatggctatcttatgtagaaaaggcagtaaaggaatgatattcactgggaggccccttgtgtaggtcaggaactatgttaattattacatcttatttcatttaattcttgcaatgatcttaaaaggtaaatattatcctaattttcaaaggaagcattggaagcagagagtatgagtaacttctgcaacactctagagtcaggattcatacttaagtcagactccagtctacaggaatgggccacaacaccaagctcctcaatgacttgttttgctcttgtcctatcttttgtgcacttacatctttatcactatgttcaaaactaaaatacaattttagtgcttattttatccagttttattttttcaggttaataccagccacagagcaatttagattccccatctccctttgaaaaatatacaattcaataaccatacatgtgcatgtgtctttataatagaatgatttatattcatttgggtatatacccagtaatgggattgcagagtcaaatggtatttctgggtctagatccttgaggaatcgtcatactgttttccacaatggttgaactaatttacactcccaccaacagtgtaaaagtgttcctatttctccattgcctcaccagcatctattgtttcctgacttttgaataatcaccattctgactggcatgagatggtatctcattgtggttttgatttgcattcctctgatcatcagtgatgatgagctttttttcatatgtttgttggctgcataaatgtgttcttctgagaagtgtctgttcatatcctttattcactttttgatgggtttttttttcttgtaaatatgtttaagttccttgtaaattctggatattagacctttgtcagatgggtagattgcaaaaatgttctcccattctgcaggttgcctgttcactccgatgacagtttattttgctgagcagaagctctttagtttaattagattccatttgtcaattttggcttttgttgcaattgcttttggcatttttgtcatgaagtctttgcccgcatctatgtcctgaatggtattgccaagcttttcttctagggtttttatggtttggggttttacattgaagtctttaatttatcttgagttaatttttgtataaggtgtaaggaaggggtttattgcagcactatttacaatagcaaagacatggaaccaacccaaatgcccatcagtgatagattgaataaataaaatgtggtacatatacaccatggaatactatgcatccataaaaaggaatgagatcatgtttttcctgggatgtggatgaagttggaagccatcatccttagcaaactaacacagaaacagaaaaccaaacactgcatgttctcactcataaatgggagttgaacatttagaacatatggacacagagaggggaacaacacacaccaggacctgttggagtgtggagggtgaggggagggaacttagaggatggatcaataggtgcagcaaccatcatggcacacatatatctatataacaaaactgcatgttctgcatgcatatcccatttttttagaagaaatgaagaaaaaataaaataaaaagactttaactcagcttcgtatcctcaaaaaagagaaaaatatgcaattcaaatttccctatgtacaaactaaattcttaaaaaagttaaaattttgtcttaaattacaaattataaatgtaaatcttaaattataaattcttaaaaatacatgtcccccgtagtgagaaagagctgcagttaaaacagtggttagcaattcccagtctagtagtctaacaaatagataccttgtacattcagtgttttattttgcttttcattgtgttaaataatttttactaatattcacagatttcaaatgaggacaatttaaaaatataattagctcagagcagaattccacaaaattagtccttcatgcttgaactgagtgacctgttcatgtactaacaaatatttcagtgtccatctctgaagggcaagatttcaagtctcaaagcttctcacattgcatgtactgagaaactatactcctatgtgattgtcataaaactgaatcctaccaatgaagacgaaatgataagaaattcataagtcctcctcagagacagaaagtacattcccacccttatcacctcccataattgttaaggatgacaattattatagttatatttattgaactcatactatgtgccagtaattgtgctaggtgctttatatacaccctactggctgcctttttaggaggtattagtaaccttatattctttgattcagtaatttcaaatgcggaggcttacaacatttgtcattcaaaaaaaatcactcactgactctaaagtccatgtttttgtcaccatgttgtagctgctccatttaaataaaggtgaaaggagttgagagatgtgtctgctatgtacagcatctgagattaaagaaaagaaaacaacagaacaactaagaagtgtccttacattttttttattcagaatcagaatcaatcagtgatggtttgtaaacatctacagatatgttttgcttcttttgttattacttagggtgttgagagttacagtttatagtatcatgtctttttttttaaagaaaaaaacaattctgtctt

SEQ ID NO: 1205 - DNA, 38325 bp, Homo sapiens
aagagtcatactcaaatatacctttagtaatcacataaaatatacccggactctgactttactccattccatgaaaatttatttgaggtgaataggagatctagaagaaaacttagaatattatcgtcatggcattgggggaggcaaagattttcacttaaaataataaagagctctagccataaacaagactgattaataagattaagagaatctgttcatctaaaacacattattgagatagtgtaaaagcaaaacagatttgtagaagacattaaaattgtatatgtattttaatacatgtacatatatgcctgtgtgcatgtgtgtacaactgaaacccagaatatatgtaaactacaaatccatttttaaaatacaaacatctcaataaaatttggcagaaaagacctcaaagggaacttcctaaaagacatggttaaatgaccaataaacacatgaaaaagtgctccgaaaaaaaaaaaaacaataaatagctgggcgcagtggctcacgcctgtaatcccagcactttgggaggccgaattgggcagatcacttgagtccaggagttcgagaccagcctgggcaatttggcaaaaccccatctctactaaaaaatacaaagattagccaggcttggtggcatgcgcttgtagtcccagctactgaggcacgagaatcgagcgagcctgggagcccaaaaaacaatcaaaaatcgataaatgaacacttttaaaaagggtgctcaatctcattaattagcacaaaattgcaagtgtagacataaggagagatcactacactcccaaagagtggctggaatgaaagaataattgcacagtgagttgtgtgcatgtggcgaatctggaaccttcaaacatttctggaccccgattcctgcacagacatctgaggctatggctgaaaggtcagatagaatcccagggaagagctccctcaggactgagaaccaaccaaggaaaagcacccaaccctggggtgagacagagctcccaaggtcagctgggtgccctcgtggctgacacaagagttccccgagtcccaccacaggctcagagaatccaaggaacagcaccccactcccccacagcaccaggagacagcacccacagataataattttaaaaacccagcaccaagagaaagcgtctggtaagcgtccccatcagggataagcagaaccaaagaaaagccaacacatcctagctgagagcgagcaacatctaaggacaaatgtgccccacagccgagaacagcactcaaggaagagtccctcacaggctgagataaagcccgcgacagagagtgaccccatagggctgtgatcatgtgtccagggcacagccaccaccaccccggcccttgaacatagacagagctcccaaggcagagtcccccctcagggctgccaccgagcagggaagaaacacggccacacccgaggctgacacaggcaaccaaggcagggtccccaaccctgggcttaggtcatttcagcaggaaaagcccctcacatcactgagggagcccccaagaaaagccccccggacccacaacatagccgagatggggtgcccaaggaaaacgctcccccatggttgacacaggctcccatggcggtgtcctcagagtggagccactttcccagggaaccctaccacacacccgacagagaacacctcagaaaagacactttctgaggaaaaaggacactttcccgggcgaaattaaagcatccagggaaaaactgccccactcacagtcctgaagtcctgaccttgccggaggaggggcggcagcacctcacaaaatggcagtgaagttgtggcgcctccccactgttgtaactttgtagaaacttgccgtttgggagttatgggaaacgtgccccctcgcgtgcttgggagtgatgctcatggggaggcgtctcaccagaagcaccaatccggaaaggctcaaggcggatggaaggaagggaagctgaccgctttcgcgtgccctcccccagcctaacactgggaacctgtgtggggcgccagagtccggaagagaagttttgcgctcagcaggaccgctggcgccagcgggagaaccaggaagcgcagctctccccttagctgactctggtgctctctacaggtggccttcactatcaactgcacagcgggcagaggcagaggaacacagaaccttctcacacagcgggataaaagggtgaatttggagctgacaggcaaatatatcttgtgatatatttctctggctttgatatcagggtaatattggccgcatagaatgaagtagtgttcctccgttattttttggaagacattgctaagtactggtattatttcttccttaaatgtttgatagaatttgcacgcgaagccatcttggcttggcttgtatttctggggagattttaaattactaattaaatctcttttcatgctatagtcctaagtcgattttctacttattatttatttatttatttattcatttattttgagacggagtttcactcttgttgttcgctcttgttgcccggggtggagtgcaatggcatgatcttggctcacccaacctccgcctcccgggttcaagtgattctcctgcctcagcctcccaaatagctgggattacaggcatgcgccaccacgcccagctaattttgtatttgtagtagagacggagtttctccatgtttgtcaggctggtctcaaactcccaacctcaggtgatccgcccgccttggcctcccaaagtgctgggattacaggcgtgagccactgcacccagcctgtttcttcttgagtcggtaatttgtcttccaagaattttttccattttacctaagttgtttagtttgttggcgtaaagttgttcataatgtattccttttaatttctgtaaggtcagtattaataacccccctttcatttttgattttgataatctgtgtagtcctttctatttttcttggtcagtcaagctaaaagattgttagattttttttttcaccttttcggtgaaccaacttttgatttcattgatttttctgtttcttatttcattgattttcttctactctaattttcatcattcccctccttctgcttgcttgtattaaatacatcagtttaaaacttcaggaataacaaaagatttgtttcgcaaaggaagatttgaaatgttagacatgtagaaatgcttatgatattgcaagtagcagtcatttcgaccagttaaccagaaggaaattcggtgtgctgaaaccaaacaagtgtttttttgtgccgggcttttactgattttgaaaatatcaagtctagtttgtgggaagctgtttattgcatgagcagtttatttttttaatgttttaatatagagaatgcccatgttcactaaatcccacaagtttgtttgtttgtttgtttgtttgtttgttttttaacttaaaggaaagtatgtattaaccagcacatacactatcctctttgtgctttatctctggtaatccttataagagcaccatgagttagatactgttttatgccctttttatggaaatagaatcttagagtgtacatttaagtagctctcccaggtataaccagctggaaaagtgacagaacctaggtctctcagattccagagattgcacacacgaatactatatcacactgcttactgctgtgagttcagcagagaattccttgtttatatggaaataacaaaattgatagtatccaggataattggcaacagtttacaaaccctctttacccccactttggtgattttaagtggggtcatctgtccactaaattaaacagatcttaggctggtcacacttctaaaattgtacaccaagtttgtgtgtaaaggtactttcccagggaaaaatatctgtagatttaatcaaattatccaaagagggttaggcccactacccagtgttccctggatgataagagaatgccatggagcctacacccttccagtgggaagaatagtgccaatttacttgccatttatgttctagtttttaatcagagtgttccagtcacacacacatagttagctatgaggaatatctgcagatgctggttcctccacttcaaacgagtcagctaactctaggtgaagagctttatactttggactatgtggttataaatgatgggcaggtaggataactagaacagtgtatatgctcattaatacatacttatcctttaagtctgaaaaaatgaacttgtggaattcagtgaaaattggcattctaaatattaaagtattaatatttagaattatagatttttagttgggatggtggtataaggaaggtcagcccattctcaaactgggttggaggcataagggacttgtttaacctaacctagtggtgtgaacctacaggaagtagtgatggtggactgagtcatgacttaggtaaagggagatgattctagatcatggaacatgatatagattctagacatgagattctaaactctggtaccaaggcacacattgctaagacaatctgtgatcatgtactctcaagaggatcatatatttcagctgtatagcgccaatttatgtgccagttacgttccagttataaatcaaagtgttctagtaacacacatagttaattatgaggactatctgcagatgcaggcttctccacttcaaacgagtcaaccaactccacctgaagaacttcatgctgctgcctatgtgtttacaaatgatgggcaggtaagataactctttctatttctgccctaattgtgacattcttcgtataattattttctcattggaaagatgaatataaactatatgtgttaattctcttgatttaaaagataaaatatgacacaggaaatcttatgtgaacataaaatgggaactttttgatccaagagtggattggttgtactaggaactgatttattttattttattttattttattttatttatatctttttttttttttttgagatggagtttcactcttgttgcccaggctggagtgcaatggcacgatctcagctcaccgcaacctccacttcccgggttcaagtgattctcctgccttagccttctgagtagctgggattacaggcatgcgccaccacacccagcttattttttgtatttttagtagagacagggtttctccattttggacaggctgctctcgaactcccgacctcaggtgatccgcccacctcgcctcccaaagtgctgggattacaggcatgagccaccgcacctggccgaactgatgtttttaattatcacatttaatgctcatagttgttctgcagatatgtattactatctaccctttaataagaaatcaaggctgacagtggtcaaatggcttgccccatgtgacacaagataggaggtagagccagggtttgaacgcatatctttctgactccagagtctatattctttcccactccccacaataactcctttaatatcgagattgcagtctacagtctctctttctgttatccaagtcactagtgctctgcctaaaaaaatgactaagtattcctcgtggaatatgaagcactaggtgatgttgccatgattggattgtcctgatggagatcttaatgtgagttttgtgttgtgtatgagagagacttactaacttcaccattagaacatgaagacaaaggagattgcatctgcactaggacacaattaggcaataatctcttctgtaacaaaaccagactaaagttattccaccacattcccaaaactcctcaattaattaggcttttccttaattttctgtgcctttattttctcttttttaacaatagtcataagaatcacacctcactcatagggattggccaaggattgagttaatacatgtaaagcattgagaacagtacctggagggtagtaaatgttcagtaaaaatgttttcacacattctccactctgcttttataggaaatgaaaatggtttggaaaattttttaatcaaaattatatatttgaatataattttcattaaatatgctcctgcatatttaatgcaagagcatattctttatttcttcaacttttactttaagtcctggggtacatgtgcaggatgtgcaggtttattacataggtaaacgtgtggcatggtggcttactgcacctatgaacccatcaccttggtattaagcccagcacccagtagctatttttcctgatgcattccctcccccaactcctcccccaacaggcccagtgtgtgttgccctgcccgacgtgtccatgtgttctcatcattcagctcccacttataagtgagaacacgtgctgtttggttttcttttcttgcgttagtttcctgatgataacggcttctagctccatccatgtttctgcaaaggacatgatctcattccttttttattttttttcttttttttgagacggagtcacgctctgtcgcccaggctggagtgcagtggcatgatctcggctcactgcaagctccgcctcccgggctcatgccattctcctgcctcagcctcccgagtagctggtactgcaagcgcccgccaccacacctggctaattttttttgtatttttagtagagacggggtttcaccgtgttagccaggatggtctccatctcctgacctcgtgatccgcccgccttggcctcccaaagtgctgggattacaggcgtgagccaccgcacccggccgatctcattcctttttatggctgcatagtattccgtggtgtatatgtactacattttctttatccagtctatcattgatgggcatttgggttgattccacatctttgctattgtgaatagtgctgcaatgaacatacatgtgcatgtatctttataatagaatgatttatatttctctgggtatatacccagtaatgagattgctggatcaaatgatatttctgcctctagatctttcaggaatcaccacactgtcatccacatggttgaagtaatttacactcccaccaacagtgtaaaagcagtcctttttctccacagccttgccagcatctgtagttttttgacgttttagtaatcgccattctgactggcatgagatgttatctcattgtggtttcgagttgcatttctctaatgatcagtgatgttgagctttttttcatatttttgttgcccgcgtgaatatcttcttttgagacgtgtctgttcatgtcctttgcccactttttaatggggttgtttggttttcttttgtaaatttgtttaagtttcttgtagactctggatagtagacctttgtcagatgggcagattgcaaaagttttctcccattctgtaggctgtctattcactctgatgatagtttattttgctatgcatatgctctttagtttaattagatcccatttgtcaacttttgcttttgttgccattgcttttggcatttttgtcatgaaatctttgccggtgcctatgtcctgaatagtattgcctatttttttttctagggtttgtatagttttgtgttctacatttaagtctttaatccatcttgagtaaatttttgtataaggtgtaaggaaggagcccagtttcaaattttgcatacagctagccagttctcccagcaccattaattaaatagggaatcctgtccccattgcttgtttttgtcaggtttgtcgaagatcagataattatcactgtgtgatcttatttccgagttctctattctgttccattggtccatgtatctgtttttctgccagcaccatgctgctttggttactgtagccctgtagtatagtttgaagttaggtagcgtgatgcctccagctttgttcttattgcttaggattgtcttggctattctggctcttttttcgttccatatgcattttaaaatagctccttctaacttggtgaagaatatcaatgatagtttaatggaaatagcattgaatttctaaattactttgggcagtatggccattttcacaatattgattcttcctatccatgagcatggaatgtttttccattcatttatttgctctctgatttccttgagcagtggtttgtagttctctctgaagaggtctttcacttcccttgttagccatattcctaggtaatttattctttttgtaggaattgttaatgggagttcattcatgatttgtctctctgcttgcctgtttttggtgtagaggaatgctagcaatttttgcacatggattttgtatcccgagactttgctgaaattgcttatcagcttaagaagcttttgggctgagacaacgggattttctagatatagggtcatgtcatctgcaaacaaaggtaatttgacttcctttctccctttttgaatactctttatttctttgccttgcccgattcccctggacagaacgtgtaatactatgttgaataggcgaggtgagggagggcatccttgttttgtgccagtttcaagggtaatgcttccaggtttttcccattcagtatgatattggctgtgggtttgtcatatatggctcttattattttgaggtatgttccttcaatacctggtttattgagagcttttaatataaggggatgttgaattttatcaaaggccttttctgcatctattgagataagcgtgtggtttttgtctttagttctgtttatgtgatgaattacattcattgattggcctattctgaaatgaccttgcatcccggggatgaagccaacttgatcatggggaataagctttttgatgtgctgctggattcagttttccagtattttattgaggattttgcatcgatgttcatcaggaatactggcctgaagtttttttttgttgtatctctgccaggttttggtatcagggtgatgctggtctcataaaatgagttaggtaggagtccctcctttttaattttttggaatagtttcggtagtaatattaccagctcttcttggtacctctagtaggcaggaacatattcttgggttatcctttgatgaaaacagcttttagttaacatacatactatacccttcattttcatgttttatttaccactaacattgtaaagctcgccctacccctacctgattccaagatcaacatatcggaatctccataaggttggaggtgggaaaatttatcttttcaatctatcctacccttcattatctatatgtatcatctaataaagtattaatgattattggttaataagtaactttaaagcactaaaagaggccgggtgtggtggctcgcacctgtaatcccagcactttgggaggccgaggtgggaggatcaggaggtcaggagatcaagaccatcctggctaacacggtgaaaccccatctctactaaaaatacaaaatagccgggcgtggtggcgggtgcctgtagtcccaggaactcgggaagctgaggcagtagaatggcgtgacttggggaagcagagcttgcagtgagccgagatcatgcaattgcaatccagcctgggcgacagagcaagactccgtctaaaaaaaaaaaaaaaaaaaaaaagcactaaaagataaaaaaggtatttctttttttttctcccctaacaagggctgagacaaaatgatgtgtacttcatgagagagataaccatatgtttatacctttggatgatgaaagccactcattccccaagcattctgatttatcatgactgtaccatgtttgactttggataacaccttgtattttaccttcccttgtttcactgagacttgactaaaattagcttgccttttctgagagcatcgtgtatgttcagggatgagaaatctttgacctgtgactaaaacttacattaatgatataaatgcatggctgtgtatgcatatgaagactgtgactttgcagtggttggatttgtctttaatggaatatgttcactgatgtttttcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaaggtgagggggaatccaatctttgggcctcaaccatgtcaaaggacatttgtagtcatgtccttgagggatgaacagatatgagcacatttgcaagtggaagggcaaggttctaattaggtgcaacaatttggagttgttgcaagcgttagatgaatgaagcaggttcctgaggcagaaggagatggtgggctcaacaagaggatgggtctgctcactttctgcctgtcctcacattccgctctaacccagtgtggtctggcttcttagtgtactccaatgaaactactatcatcaaggtcaccagtgtttgctacactttggcgttaatgtctcagcagcatgcgacacagttgtttactccctcctgcacggaaagcttcttgggtccccagacacctggatttcttaccctgttactagagactcattttccttctcttttttgtttttctcctctcccttcccacctctaaatatttcggaaccccaaagcttaatcctagactctcttctcttcagtatactatctatttaggcgatgccgtgctgtcttagaattttaaatgattcacactataagaactctcaccattatacttctacactacaacttgctcctgaaatccagactcaaatacgactacactcgcggtatctttactgggtgtctaataggcatgtaaaattcaactgactctacatgctcaaatttctgacctccctctctccaaaaatactctacttttagctttcactatttcaattaaagatactgtccattaggtgaaacatccacaaaggtgtaacaaccagctgttcacaggtatgggggattgaggaatcctggtttttacagtttgcagctatccatcgggcaaataatcccaccatggcctagttcaagctgtcaacataaggtcactgaaccagattcaggaagagttggcagcactcagctctcatggtcggttgcctaacacctcctgaacacccctggtgtacttttacttagtagttctagtcaaaatacttaaagtcacttatgagttatctcatgattcttttattactctctcatttcccatttcttagcaagtccagcagtagatgcccagtataaattctgcatccaaccatttctctctatgcctccagtgcatgctgccgtgatctgtctccaggctagtacaatgccttcttagctctgtgtttctaatcttcgctcatctatcgcatactctctaaccctgtggctagataattatttcagcacgtaaatcacatcatgccatgtccctcctgaaaacccatcctcatctctcctaagcactcagaacagaccctgaaccggctttggtctccaagcctctgcacagcctggcctctgtcaccctctcctaacatgggtcccatccatttcctcctggctctctctgcctctgaccttcacctctgtagtgcccggtccatccccactccattccctacccttggcctcactgcagcctggaactctccctctgcctctgcacaggaggctctgcttctttctccaagccctgcccaatggcacttcttcagaagcctctgccaaaccagctgcagccccaggggctccctctgctgctgtctcccacaggcctgtggactgcttttccaacaccagcccaatgctgcttgtttcatttgctcattgtgcatgtactgtctgactgccccatgaggatgtgagctccacaagggcagggaacgttgctccctgggctgtttactgctgatccctgggtcctggcatgctgcctgccacagatgatgaataaatgaaagaggcgtcagacctggagtgaaaagaaagtcactttttctagataaaagggaaggatctgtagaatcatataaaaatacagatgtgtgatgatggagtggtgataagagtgttcaactccaatagccacgtgtattttctcagagtatttggggtagaaaggaggcaggttaaggagggctcacttagtctggcttcctgctgtgcacagcatggcatttataggtgaactatacaaataatatcaagtgagaattatcatcttgctgcctatcaagggcagcaagatgatacaaaatgacgaatacaaaaacctgtgaatgtttattctgctgtcgtacttctttactgcatatattcattatgccaagaggtaaaaaggtagttttattgtattatctgacctgatctctgtcacaagatctgagatttccacgtggtaaatccttctgtttcatgaaataaataattctttagaacctgattaatacacagctgtccctctgggggaggatgggacaaaacacacctatcttgcagctcaacctcttcatttggtttccagctgctagcatcactcacaatgtccatgaagagaaggtaaaaaatggccaatctgcacacaataatgtcattgcaactgttccatcagtgcttattagtatggcagcagctggtatttcatccatgagtaccagggaccagtgtaaatttgctcacttgttatactgtcctacgaggattccactacgcaccatatatgcatagtgtcgtgagggaagaaggtaattttgttgtattatcttttctggcctcaattttagggttctcagattgctacctggtatatccttcttctttatgagataatttcctagatactgagcatcagtggggcatgcctgtgccattgacataatgcacttacctcacagctcaaccacttcatttggtttccagatgctgcagtcactcacagcatttgtgaagagaggataaataacggccaaccagtagctgataatgtcttgtcaactgctccaccatggcctggtaatatggcagcagcaggaatttcatccatgagtatgaaattcatccatgagtacttattaattgtactgtcctacttggtttccataagcaggcatattttcatgaattatagaaggtggttttgttgtatattctttcttagcctcaatttgaggggtatcagatggccagctggcatatcctcccctgcttttttagataatttcctagaaattgaacacagaggaatatacctgtggggttgacataatgcacttacctcacagctcaacctcttcacttggtttccacacgctactgtcaatcacagtgtccatgaggaggggatggaaaatggtcaaccccaacgagataatgtcatgtcaaatgttctatcagggcttattaatatgacaggagctggtattccagcgatgagtaccagggatctgtgtgtgtttgtttattagttgtagtgtcctccttggtttccatgtgcatgcataatgtcatgaagggaagaaggtggttttgttgaattatctttcgtgacctcaacttaagtggactcaaatcattatatgatgtattctcctgcattaggggataatttcctagaaaccgagcatcagtgggatatactggttcaattgtcataatgcacatacctcacaactcaacctgttccatcggtttccagatgctaccatcgctcacaatatccgtgaagagaggatggaaaatggccaatctcgaactgacaaagtcttgtcaactgctccaccacagcttgttcatatggctgcagctggtattccatccatgagtaccagggatctgcgtatgtctgctaattagttgtactgtcatacttgttttccataagcatggatattttcatgaaaggtagaagtcacttttgttgcatatactttcctagtctcaatttgaggggtctcagatggccacctggcaaatcctcccctgatttcctagataatttcctagaaactgagcatcagagggatatacctgttgggctgacatagtggacttacctcacagttcaaactcttcgtttgttttccagattcaactgttactcacattatctgtgaagagaagataaaaaatgaacaaatggcacctgataaattcttgtctactattacagcggggcttatgaatttcacaggggctgatattccacccctgagtaccagggatcagtgtgtgtttactagttgtactgacctacttgcttttcgtacgcatgcagtgtcatgcagggaagaaggtggtttcgttttattatcttttctggcctaaaattcaggggtctcaaatcaccacctgatatgtcctcctggtttatgggataatttcctagaaactgagcatcagagggatatacctgtggcactgacgtaatgcacttacctcacagcttgaactcttcatttggtttccagattctaccgtcactcacaatatccgtgaagagagaatggaaaatggccaaccccaacctgataacgtcttgtcaactggtcccacagggcttattaatatggcagcaactcctattccagccatgagtgccagagatctctgtatgtccacttataaattgtgctgtcttacttggttttcatatgcatacatagtgccatgaagggagttaggtggttttgttgtgttatcgtttctggcctaaatctgaggggtctcacatcaccacctgatatatcctactgctttatgaaataatttcatagaaactgagcaccagagggatatacttgtgagttggcataatgcacttacctcacagctcaacctcttcctttggtttccagatgctacagtcactcacaatgtctgtgaacagaagatggaaaatgtccaaccagcacctgataacgtgttgttgactcttcgaccacggcgtattaatatgacagacactggtatttcacccatgagtaccagggatccatgtaagtttgtttatttgtattactgtcctacttggtttccatatgcatgcatagtgtcaaaaagcatacaaggtggttttgttgtattgtcgttcctggtatttcacccatgagtaccagggatccatgtaagtttgtttatttgtattactgtcctacttggtttccatatgcatgcatagtgtcaaaaagcatacaaggtggttttgttgtattgtctttcctggcctcaatttcaggggtctcgtatggcaacctggtatatcctcctgtttatgagataatttcctagaaactgagcatcagagggatatacctgtggggttaccataatacacttacctaacagctcagcctcttcatttggtttccagatgctaccatcacttacaatgtccctgaggagaagatggaaaagggccaaccccaacctgataacatcttgtcaactgcttcaacagggcttattaatgtggcaggagctggtactccagccatcagcaccaatggcctgtgtatgtttgcttgttaattggattatcctgcttggtttccatatacgtgcatattgtcatgaaggggagatggaggttttgttgtatcatctatcttgagctcaatttgaggggtctcagatcaccacctgtcatgtcctcctgctttatgcaataatttcttagaagctgagcatcataggggtatacctgtggggctgacataatgcacttactcacagctcaacctcttcatttgttttccagattccaccgtccctcacaatgtctgtgaagagaagatggaaaatgaccaaccgcaacctaataacgtattgtcaactgttcaaccagtgattatttatttgacagcaactggtattccgggcatgaataccagggatcagtgtatgtttgtttactagttgtagtgtcctagttggtttacatatgaatgcacagtgtcataaagggaaggaggttgttttattggattctctttcatgagctcaatctgaggtgtctcagatcatcacttgctgtatcctcctgctttatgagttaatttcctagaccctgagcatcagagggatatacctgtagggctgacataatacacttagctcagagctcaagcttttcatttggtttccagatgctaccatcactcacaatgtctgtgaagagagagtggtaaataaccaaccactacctagtaacgccttgtcaactgttctaccagggcttgcttatttggcaacagctgatatgccagccatgagtaccagggatcagcgtaagtttgtttactagttgtggtgtcctacttggtttccatatgcatgcatattgtcatcaagggaagaagacggtattgttgtattatgttttctggcctcaattttagggttttcaattgctccctggtatatcctagttccttaggagataaattcctagatagtgagcatcagagggggtattcctgtgggattgacatactgcacttacctcacagctcatcaactacatttggtttccagatgctaccatcattcacaatctgcgtgaagagaagaaagataacagccaaccaacccctgataacgtcttgtcagctgttacaccagagcttattaacttggcaggagctggtattccacccatgagtaccagggatcagtgtatgtttgcttactagttgtactatcctacttggtttccatatgaatgcagtatcataaatggaagaatgtggttttattatattgtctttcgtgagttgaatttgtggggtctcagatcgctgcctggtatatcctcctgctttatgtgataaattcctagaaactgagcatcagagggatatatacatgtgtgcttggcataatgcacttaactcacagctcgacctctttatttggtttctagatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtgtatgtgtgttttttagttataccatcctccttgatttccatatgcatgcatagtgtcatgaagggaagaaggttgttttgtgaattatctttcctggcctcaatttgaggggcctcagatcatcatatgatgtattatcctgctttatgggataattttctaaaaattcatcatcagtgggatatatcggtggggttgacataatgcacgtacctcacagcttgacctctccctttggtttccagatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtgtatgtctgttaattagttgtactgtcatacttggtttacatatgcatgcatattttcatgaagggtagatgtggttttgtagtatattctttcctaacctcaatttgagggatctcagttgtccacatggcatatcctccccagctttcttagataatttcctagaaactgggtatcagaggaatatatctgcagggctgacataatgcacttacctcacagctcaacctcttcatgtggtttccagattttaccatcactcacaatgactgtgaagaaaagattaaaaattagcaaagagcacctgatacattattgtcaactgttacagcagggcttatgaatgtcacaggggctggtattccacccctgagtaccagggatcagtgtatgtttgtttactagtcgtactgtcctacttgacttccatacgcatgcagtgtcatgcagggaagaaggtggtttttttgcattatcgtttctggactaaatttgaggggtctcagatcaccacctgttatagcctcctgtgttatggaacaatttcttacaaactgaacatcagagggatatacctgtggtattgacataatgcacttacgtcacaagtcaacctctttatttggtttccagatgctaccgtcactcaaaatgtccatgaagagaggatggaaaataaccaaccacaacctagttatgacttgtcaactgttctaccaggacttacttatttgacagtagctggtattccggccatgagtaccagggatcagtgtatgtttgcttattcagttgtactgtcctacttggttttcatatgcatgcctagtgtcatgaataggagaaggtggttttgttgtattatctttcatgagttcaatttgagtgttctcagatcgccatctggcatatcctctccggctttatgatatacttttctagaagctgagcatcaggaagatatacctgtggggttgacataatgcacttaactcaaaacttaacctctttatttctgttccagatgctaccgtcactcacaatgtccatgaagagaagattaaaaatggccaagcagcatccgataatgtcttctcgactgttccaccagcatttattaatatggcagcaactggtgtttcatccatgagtaccagggatcagtgtaagtttattcacttgttgtactgtcatacttggtttccatatgcatgcatagtgtcatgagggaagaatgtagttttgttgtattaccttttcaggcctcaattttagggttctcagattgctacctggtatatcctccttcttaatgagataatttcctagatactgagcatcagaggggtatgcctgtgcggttgacataatgcacttacctcacgcccaacctcttcttttgtttccagatgctgcagtcactcacaacatccgtgaagagaagataaataacagccaaccagcacctggtaacatcttgtcaactgctcctccatggcttcgtcatatggcagcagctggaatttcatccacgattaccagggatctgtgtatgtctgcttattagttgtgctgtcctacttggtttccctaagcaggcatattttcatgaatggtagaaggtaattttgttgtatattctttcctagcctcagtttgaggggtatcatatgtccacctggcatatccttgccttcttttattgataacttcctagaaactgagcatctgagagatatacctatggggttgacataatgcacttacctcacggctcaatctcttcatttggtttccaaatgcaaccgttactcaccatgtccgtggagagaagataaaaaacggccaaccagcatctcataacttcttgttaacccttccatcagggcttattaatatagcaggagctaacatcccagccatgagtaccagggatctgtgtatgttttcttataagttgtactttcctacttgatttccatatgcatgcatagtgtcatcaagggaagaaggtggttttgcggtattacttttgcttgcctcaatttcagggtctctgattgccacctggtatatcctcctgctgtatgggataacgtcctggaaactgagcatcagcaggatatccctgtggggttgtcattatgcacttacttcacagctcagcctcttcattttgtttccagatgtcaccgccactcacagtgtccatgaggagaagatgacaaatggccaacaggcacctgataactccttgtcaacggttccacctggttgtattaatctgtcaggagctggtatttcatgcagaagtaccagggatctgtgtatgtttgtgtattggttgtactgtcctacttggtttccatatgcatgcatagtgtcctgcagggaagaaggtggttttgttgtattatcttactcaaacttagtttgaggggtcttggatcaccacctggtgtatcctcttgcttcatgagataactccctagaaactgggcatcggagggatatactgtgggggtgacataatgcacttatctcacagctcaattttttcatttggattccagatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaagtaagtactgcaagaatgtctatcaatgaaagcatgagaagtgtctcattctatgatttagaacagaattgagctgcctcttgagctcattgtttggctgaattggatctatatataatttagcatggctttactttaatttcactgaaaattgctaatatgtctgcttaagtgttttgttttcctttgttagtgttcacaatagtttccttagtaatatacagatgtcgtgatttaagcattcaaaacaagcactatgtaacattgtagcccatgaaaaatgtatactgtggtagtggatgcactaagattgaggtatatttcatttttgtaattgtagaaatactaatttttaaaatatcttcagattatgaaagaattttcattttgcttgaagaggtacaaggatctatgaaagtcaagagacaatttgttgaatttaccatcaaggaagcagcaaggtgagtgcaaaaaggaactgtgctattgttttaagcacttgcgcccaatttgggacaggggcaggaaaaaatcatggtttgttcctcctaatccctggccctcaatcatagttcatgctatttccacaggcatttaggttgatactatcttattctaacactttcttccaataccatggaggcttccaaatttatcaaaatctgggagtgtatgtgggccctcagttgactcactttgtatttttctagtttgtatctttcaatgaggatgcattttctgtttgcatgtagatggtaaattctattttgtatccactctacctcttacatctcatagatcctgtaggtatcctctggtgaatggaatacctctttaatttcaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgcacttttcttgtttgttggtttcttcttccacctgaggagggatatgagttaataactcaccaagatatttagtattacagtcctggtttctgcagcacctcacattgctgtagctggtacttataactgccttctttcactacccatttctcattccctttgccctgagatagtatgtcagccagtcatggtgcttggcctcgcaggttgactcaaaccttcattactgaacattctggaccattcgatatcctgcctggattgggttgctgtaattttccattaagtgtaatcaaaaaacatgggaggggccaggcgcagtggcccctgcctgtaatgccagcactttgggagactgaggcaggcaaatcacaaggtcaggagttcgggaccagcctggccagcatggtgaaaccccgtctctactaaaaaaaaccaaaaaattagccgggcatggtggcccgcggctgtaatcccagctactcaggaggctgaggcaggagaattgcttgaacctgggaggtggaggttgcagtgagctgagatcacgccactgcactccagcctgggcaacagagtgagacttcatctcaaaacaaacaaacaaacaaacaaaatgggaggtctaagcagctctctagacatatcagacatactcttttttagcccctggtgtagtgcaattaatccccctttcatcatcaggttcatcacccccagccactagatgaccccctcctttgattctggatggaaattgatgaagacaccaaaatggccagctggcagtatcaatctgttctcaatagaatcactgttgtgtcgcttggtgaaagcatttcttcctttggaactaagacttctagttcagcagagcctaaagtcagaaggataagaagcatttttgctagtcgatcactggggtgaatagtgaatagagacactcccagttttacttcttgattctaggacccatgaatcctaactatgggagagaaagcaaagtatgctggatgcagatatactgcaaacactgcttcctaaaagtaatttctctgacctgcaaggtattgccacctagctagcactgtaactgagttccacaaggccattccactgttctgttgatccagtcattttaagataatggggggcactttgggaggctgatgtggagtcacagaccaagtgggcaagacactaccatctcttgaaaaaatgatgggggatatggggatatacgtaataagaacagtgaatttctatgagcatgggcccatcactgcactttttatattctgtgaagtgagggccttttttcgaggtgatgctgtgtggaataccatgatggtaaataaggcatttttctaagtgcacaaatgttgcttttctcaaagtactgtgggtgggaaggaagatccataatcaaagtaagtgtctatttgaggaagaacacagccctgtcccttccatagtggaagtggtccagtgtaatcacctgccatctggtagctggctgataactctgcaggcaggtgtcatataagaggctcagtgttgctctctgtttctggcagattgtacactcagcaatgactatgttgcagaattttgcttcttagataagctaaaaccaagttcttgtcacacgaccaggaaagattaggttcgcggatgcattgaagggtgaggagcggaatttattggttgaaaagaaaaaataggaaggaaaaaaactcggcaaagcgagagggagtcctgctaacaggaccccatctcacatattgattctgggccaccacacaggaaccgaagagaccaggctccccaccgccacccttgcacaaggtgcaaacttcccgtggctccacatccttcccccagtacatgtcgccattattaagaaagaatcagttgggaaagggcgagcaaacagtgacggttctccctctggatcgcaggttacattcgggaccagcagtctggtttttcaaccttcaggccattttaggcttgaaggcaggtttctccaggaatcctttgctgtctcatgtctttattaactgtagccaggttggccctggtgagtggaagtccatgctactgaagcataatctctatccctggtcaccttagccactttgtgaacccatgaggttgtgacacaagtgttggggaaagaggctgattaatatctagataataggtaacttatccttcagattattaaaattcttctctgctgaggttaccctttgctgagaactctcatgagacccaaatatctcataggcctggccatctctcctccacacaggagcactgctcaaagttcttccccctgagagaatttcccttcaccactgtccttcaggactatgcagctgtccacttttggcttttgtggcaggcaggcattgtggaccgactgaatatttgtgtcctctgagaagtcatacgatgaaaccctgactcccaatgggatgatatttggaggtggagcctttgggaagtaattaggtttagatgtggtcatgatatttgggtccctatgatgagattagtgcccttataattaaagaaaagagaatttgttcttccatgcttcttcaacatgtgaggatacagcaaggtggctgactacaagttaggaagaggacgctcaccagaatttgagcatgctggcaccctgatcttggacttctagcctccagaaccttgagaaagaaatgtctggtgatgaagccacccagtctgtggtattctgtgatagtagctcgagctgagacagctgtagtctgattccccagattcccatctcctgtatactcaatcaagcactaatccaaatactgctatggtgggattttgctggataattaaactctcaagtcagttgaccttgagacatggaggtggtgtgggtgggccagacctggcaggggaatccttgagaagcagagcatttttcttaccaaggagcagaagaagaggtaagaaagtcaaagcacaagaaggatgtgacacagcaggcctgctttgaggataatgccgtgctcctgagaaggtatatggggtggctctaggcgtttagagaagtctctggatgacagccagcaaaaaaaatgggaaccacattcgtaccacctcaaagaactagatctaaatgggcaataacctgaataagcttagaagtggattattccacagtctccacatcagcacccacccggcctgacattttgagttggccttgggagacacacagcagagaggccggttgagccttcccggtctcgatttgcagagctgtagataataaatgtgtgttgttttaagctgctcaatttggggtaatttgttatgtggcaatagaaaactaatacaggtgctgccagcccattataaagaaagaatagtaagtaagccaggcctagggattttctgattgtttcttttttagacaactctgttcataaggaacccccctcggagccataggtgtgggttcagagagcttttccttgtactaagccaaactcagaagtagcagattttccagtcattagcagataagtcacagcagcacacgccaatgaggtacatgttaccaccatcagaacctaaagaggcccactattttttgtatcccctttgagtggtaggaagggtgagatgtaccaacttgctgttcacctgataagtatgatgttgacatgcctctgagcgcttgaccattaaatatttcactaagtttaaaggcccctgattttttgtgtgaattgatacttaggttgtcatgtcagtatgttaccagtgtgtctagagtagttgctaggtcctgcccaatcagcataatgtcatcaatgcaaagtaatggtgtcacatggttggagggaaaggagatcaagatccctacggattagtttgggacataagtttatgatgcaggatactttcttgaccccttcacaggactcatgacaggggtgccgagccactttggcaccagcaggagcaaactccttttcctcgggcccaccgcacaccacccctcatgggagggaatacgtaggcaagtgagtgtgggaactggccagctgctttggcactggcaggagcaaactcagtccaggctctgtggcagcatccagataggaatgcctgcgaccccaaggccccagagtgcgtgttacaatgctctcctagctctaccatccacaggcagcagtgtgttatcagctcagtgggacctttgcctcattgcttggggtggctgccctctgtcagcaagggcaaaggcccaatgcgacagcctttttgggtacccacacatggtgggtcccaaattcttgtctggtgcccaagaagaatgaggccacacagatgaattgaaggatggtgagtgcagagaattttattgtgcaataaaagcagctcgcagcagagaggggagctggaaagcgtatgggaagggcaggtcgctctcccctgaagtcaagtcgcctctctgcctctctcctccgaagtcaagttgcttctcccggacgtgcagccatcatctctgaagtcaagtcacctctccctgatgtccagctacttctcgtctctactggctgaatctggaatctttataggcgtgggaccgggagcagggcaggctgtaggtagttatggaaaaggcaacattcgattggtaaaaagacattattcagaaagaaccaattgacagagcggccaaactgggatagaagttctcacttcaggcttttcagcttgaaggtgtggtttcaccaaggaaccacccttgtctgcctagagtttctctgcctcctgcctctatcacttagagagttgatataagactgaggtaggaaggaaaaggggttttgctggccttgccagctgaaagcaaacagttcctcatgatctttaaaaaacatgtatagagtaaaaggcattcgcatgatctgacacacacacacacacacatataaatatatgtatgtatatatgcatatataatgttaaatacctatctaattttaaacatctatctgtctacataaaagggagttgccatgtagaattggtctggtatagtatttttacatgactattccatctctatcaggctcttacctcacgtataatactggataaggggacaaacatttctggacttgccaaaccatattttgtgcttgaagaatagagtggaagcacccagtgacggtgcgttcgctgaaatactgcccttagtaagcggagaggctctcaccccaaatactcgaggctcctgggtctgggcacggagcagccctgtgcagcaggcaggctggatatttggcttcttagactctgttccaaccctagctgcttacgacctgggatgggtcttttccttcttggggtctcatttgtatctctggaaaatgacaatcctgggataactgatctctgatgttccttgtggccttgatagtcctgtctgggtagattgctatccctggccacaagagtggtgtgtttctgtaattcctttattcaaagacttcgaactggtctcgaactcctgacctcaggtgatccccccgccttggactccgaaagttctgggattacaggcatgtgtcaacgcactcggcccataattttttaaaaatcaaaattaatagaaaacttccacaatgaacaaaacattgaaatttaaaataaagacaggatttgcccttgcacttgcagagccctgagagtcatgcacgtggaggggacatgtgggtgccacaggcctgtgacttaaaaacgtcttacttgcaattttctgtgatgaccactgcttccttctgagggaagctggcaattgttctctttctatgctcatgcaatccatagtgccacagggtggaaaaaagaaatcgtttgatttaattataaatatgtctgtacaatttttgaaaatattctaaagaaccctcaagtaggtcatgcaaattttattcattaaaatatttgacttttctgaaatggaatttcatcaaatagcaaacattttctgaaatagtattctttcccaggaaaatagcaattatcaaaaaacctttatactttcttcacggaagacagttatgaaaattacactggtgttcacttcgtttttaaaaaattaattttcaagaatttttgacagtcagatttgataagcctggtgtgaaattttttatgcttaataactattttttatctttatataaatttttatggacatctgtgtaatgactatatattgtaaatcacacaagtatccataattaatataaattacttgattatgtattagagagcacatttactctaaatagattgtattaattaaaagtaaatatattcgtaaattatactaaaattatttagacagttaaggcaccaaaggtaagtggtgtaatgttcaagaaagaagtaaaatgcatgtggaaatttatcaaaattatgggagtcattcaattatgaggttgacttgaaaaagtattgcagctgctgaaaaatgatttcctatcattgacattatcagaacacagttaccctcaaatccactgaaaactaaggaaactttttgaaatggtaagaagaaattgaaggggagtgttagatatttcagaaacacatagtcatgagtttgggctaataaaacaaaaggggctttactagacagaatatggacaagaccaagaacaacatgcagattctaatgtattcatatgatgactggagatttttaaaaagatgggtgtgtggctgggcatggtgtcacattcctgtaaccccagcactttgggaagctgaggcaggaggatcacttgaatccaggagtatgagaccagcctgggcaacatagcaagaccccagctctacaaaagatatgaaaattagatgggtgtggtggtgcacacctgtggtcctagctactcaggaggctgaggtaggaggaccatttgaactcaggagatcaaggctgcagtgagctgtcatcccactagtgcattccagcctgggcaacagagcgagtccctctctaaaaaaaaaaaaaaatgtttatgagaaaatatgctaacaactaacagagaatggattcatcctaactggattgtttattccaaataatgtttgtctttatctggctctctgcaaatattttttagcagtcatgtgacagaatcagatgtatgaaactcaaaaaaagggagttcacagattggaagaactgaaatagaatttggaaacatgagaatttcctgttccagcacgatgcttttccaaaatagaagtattatggtatgtatatacagactcatatcttaatagacaatggtttgcaggtgattaaatcaacaaaagtggtagaatattttggagtgttgttgacggctattctgagacattggttcttgttttcttagtttaaaagaatttaaacaagaggcacacagcaaaggagatgcagcatagagaaatttattgccagggaaaatgaatattttgaaagttagatgcagaatacacactgagagagacagagaagattcagggctggctggtcataaggatgagacagcattgattattactggggaaactccctttatgggagtcttacatgattattcataaggaggtgggaagaactgttactagtaagcatgttctgggtggtcctctgggtccacgtgcccagtagctacccatgcttgttcatacatcacatgtctcattagcatcttaaatctccacccaggggtgtgttttttactattataatgagcaaagggtcagtttgaggacaggtgaaatcaaagtgcacatgttctctacagaggaaattccctactgaagatagctttgcttgaatgagcttaactgcaatgtgaatgctgaggcttattgtgttggctgtacggtccccacggttgctgcatgccaaggacatggtcacttccttcactgcctaccctgcctcaattcccccctaagagatcttagggcctataatcatatgggaggttgaggggctaggtcatttcttctgaagctgcttcctgctgagtggggtgttgtccctgcctaacctgggccctaaagtctcttcctgcctgatctaatgcggtgtaaaccttgttgttcacgggactggtgggcaaagcatgagatagctcattagcagctcaaggttgaaagccttgtgaaaccaacctgtggacttggaattgctgtaagcaggagagtaagaaatcatcattataaacaaagttggaccaaaagttaaagtatgttaatgaccggcactattaaagggagcaaggcagacaatagctactgcttcctaattcccatggaagttcctaaagtgttaatttcgtttgcctgagtaatgatatttttaatattttcttggactaaaccagactgattgatgtaaaaagagcattcctctttcaaatacaaacatgtttctctttgtccagctgtgagaagatttaaggcttttcagttttgtaggattatactggcgagggagtccagctgttgttgaagtccagtgaggccctcttccatttgttggagagccaccatgatctcctaaaacagtttatgctggattcccaaggctccacctcccatagctgaccctgataatcccaacagagagggcaatactaaacacaggggaatatggggtcttgctcagaggtgaatcttgctgtgctggtacatgggggaagggagagatgtgttagcccatgcgaaagttagataaggggaaatgtaagcgatggagcatcgccccttccacagtggaggtaattgtagatatgctgaagatccacaaaaccccaaaattttttatgatggtgaaatttctgctgcaaaagtattttgcattaaagtggtgaatgcagtggaggttctctaaaaggggtctcctattttctggcctgtaagtgaaaggttttgtgcagataagttggcaatggttactgggtctattaatgaatggtagagttggatggtggcattaataaattctttaaataaagttccccctttagggttccaccacagaacatagttatcttgtgatagaatatgttgacagtccttggcggatgtattgagataaggtgaataggggcttcccgtgagaggatggcctcagcaaaaactagaggttgtagtttggttgataggaaatagaggtggtgccagtccgaggacataatagagcaaaaaattggttgtctggatgaggtgtccatttattattagtttaattcccgtagaggtattgactaaaatatgtgacccagtgataaagggtcagctacactgactctcttggagttctatgaaagtggcagaactgccatgattaatgtaaaggcagaagggaaattgctctggataaaaggtatgtaagaaagcattttttccttttgagatatttgaactactgttgataattaggaggaggagcttaaggaacccaggacctgacctaataaaatccctttgtattgactgttgggcctgatatcccccctctgtgggccagtgagtttgtccctggagatgtgctgggatgccaggccagtcttctcagggcccaggtctggcatatccccaacatttggtagttatgcaaagtcaacaaggttaagtttttttgttttttgtttttgtttgtgtgtgtgtttgttttgttgtgttttgtttttgttttgttttgtttgagacggagtttcactcttgttgcccaggctggagtgcaatggcacaaactcacctcactgcaatctctgcctcccgagttcaagcaattctcctgcctcagtttcccaagtagctgagatacaggcatgcgacaccatgcctggctaattttgtatttttagtagagacgggattcaccatgttggtcaggctggtgtcgaactcctgacctcagttgatccacttgcctcggcctcccaaagtgttaagattacaggcgtgagccaccatgcccaggcctgagttaagtttaatagactaacagtatggttaattacttccccagcagacaggccagtgtctctaaaagtcattacagtatggcaggcaagtaccaagaaaatgaagacgttacctatcttccagattggctttatctggaattgtgttctagaatagaaagtttagagcctctatgggctggcaggtataattagtagcttcctctggttcgtgtaaagatttattgcaaagttgaattctgatcatgtgaacccgactggctattccttgcagctcgacagccactggggtggtgagtagtacttgctaaggtcccttccatttaggaagaagtggatctgccaggtggccttccttccaagtttttaataggaccctgtctccaggtaggatttggggaatgtttttcacttgtccaggtgagggcagcactgcattgccatactcctggatagcttgctgtacccaggttagttttttgttttgtttgtttgtttttgacatcagactatttctctgtcacccaggctggagtctagtgatgcaggctcggctcactacaacctccgtgattctcctgcctcggccacctgagtagctgggactataggatggccaccatacccggctcgtttttgtattttgggggtttcactatattgccctgtctggtcttcaactcctgacctcaagtgatccacctgcctcagtctcccaaagtgatgaaagtacagatgtggatcaccgcaactggcccctggcttagatttcgattatattgtatagtagacagggtttctagtttgattaacaggtctaaggtaaggaagggtctcccagaagtcatctcaaacggactaagttttgtcttttctttgggtgccactcgtattctcatgagggctataggcaacagagtgtaccaagactcagaagtttcctggcacagttttgccagtgtctgccttaaagtttgattagtcctattaaccttgctggaggattgtggcttccatgaggagtggagatgaaatttaatttccaaagcttgggctatctattgggttacagttgcaagaaaacaggggcctttgtcgctctgcaaggagcaggggaggccaaatctggtatgacctctcttggcagtgccttggccacttctgtagctttctctgttctggtggggaaagcttctacccattcaataaaggtgtctacaaaaactaaaaggtatttaaaaacccaaaaggagggcatttgggtgcagtgaatttgcaattcctcaccaggataggttcgttaccactggactgaggttaataaaggaggagacccttgttttttgtttgtttgttttgtttgcccccaaggtaactttgagagcaaagttcacaagcccgagtgaccttttttattgtggttgccaggcctttacctgtaaaaacatggttcatccaggcgggtcatagcgtcctgccatatggagggaattatgtaaacttttaacaatttgccacggtgggactgaagaagcaatagcttttggcgtatgagtcaccaaccctcaggtgttacggtcttcgattttcttaacccatgctctttcttctatagtataggatggatttatatcaagagaatgggacggggcatggtggctcatacctgttatccagcattttgggagcctgaggcgggcagatcaactgaggccaggagtttgagaccagcctggacaacatggcaaaccccttctctgctaaagtacaaaaattagtggcgtgatggcacctgcctgtagtcccagctactcagcaggctgaggcaggaaaattgcttgagcccaggaggcagaggatgcagtgagccgagatcatgccactgcacttcagcttgggtgacagagcaagactcagtctcaaaaaaataaaaaataagataaaatatagagaatgggcagagaggaataaggccagcggggctacaccttccgtgattgccctgctatcttgcctgccagcctttgcattgtccaatgagactgaggagtttcctttttgatgtctctcacagtgaatgaccgccacttgcttaggatcattcacagcccctaaaagctgcagtatttctttactatgttcaatgggggaattccttgcatttagaagaccccgtcctttacagatagcaacatgtgcatgaaggacaaagcaggcatccttggagtcaatatatatgtttagtatctttccctgacctacagccagggccctagcgaggagaattagctctgctttttgtgctgaggcattaggtggcagtgcctgggcgtctattgtttgctgtagactatccacattatatcctgcccttctttttccattttccgtaaaaatacttccatcagtgaaccactcagcatcaatgtgattagatatcgacacatttgtatgtgaaataatttacctcacaaaagataacaggaaattattgaaagtccaaatgttttaatatttctaaatttaggtgaacttacaagtgtttataatgatgctatggttaacaacagagcaatggtcatgtgtctgactggtcttaaaaattcagaacaaatacttaatgcttctgggaaatcaaatcttttgaaaaccaaacaagcaaactgtgtattcccaattttttaaattttactttatgttctgggatacatgtgcagaatgcgcaggtttgttacataggtatacatgtgccatggtggtttgctgtacctatcaacctgtcatctaggttttaagccccgcatgcattaggtatttgtcctaatgctctccctcccctcggagcatctatggcaggtgtatacaagcgtacatacctgccagaatttaatcaaaaatcattatgccaaacatgagactcattgggttcatttttttgtgtgaattcaatgagtatatggaagttcttatatctgttcaaaataacacatcaaaatatatctggaaaattatatatttatatagagacatactgggcttcaagataacatgcaatgaagaaactaaaaactaattaaagatggttatcaaatattaaaagacatggccgggcgcggtggctcaagcctataatcccaacactttgggaggccaaggtgggcagatcatgaggtcaggagatccagaccatcctggctaacacggtgaaaccctgtctctactaaaaacacaaaaaattagccgggtgtggtggcaggcgcctgtagtcccagctactcaggagtctgaggcaggagaatggcatgaacccaggaggcaaagattgcattgagccgagatcatgccactgcactccagcctgggtgacagagcgagattccctcttaaaagaaaaaaaaaagacatagtatgaaataacataaaatattatgccaagtagaaagtgtcttttcacatgcagattacaaatatgtgtgcaacattttggcttaataatattttcaaccaagtagaaaaatttaataaagctctacaattaaaaaaaaaaccatatctaggccaggtgtggtgctgaggtgggtggatcgagaacagcctggccaatatggtgaaaccctgtctctacaaaacaaaataaaaattagccaagtgtgttggcatacacctgtcatcccaccagctactacagaggctgatggggaaggatcacttgagctcaagaggtcgatactgcagtgagccgtgattgtgccactgcactccatcttgggcaacagagcgcaaccctgtctcaagaaaaacacacataactatacatacaaaaaagcaaaactacctttgcttacagaaagtggaagaaagtgtgtgtgtatatatatatatatatgtatattatatatgtatatatatatacacacacgtgtgtgtatatgtatgtgtgtatatatagtaaataaaaaaaataaattaaaaaataatattgtaaggtttgtgcacctactttccaatttttcaatacatttgcaacaactttaatgttctggaaacactaattgtttaaaaatttatgaaaatatgtttatcgaggtgcacatttcccccgtgccttgggctccagtgtgactgcacagcactaagtaagggcaggggattagggctctccacatccaggcattgtgagtgactcttcccagaatataaaaaggagagaagtggaagaaggtaggggtggctctgaaagcagaggtttttcagcaccatctcagctgacatctcactgtcaacaactgggtcagaggaccacccttactgaaacagagtccaagacggaaaatatttttttaaaagggctgcccaaaacaaaatcagggttacaatagagaggaagaaaggggaatggatagcaggtagtcaggtagcaatgcctgcccacaaatgagacactgaaccatgacacagatagactgtctgcaagtggaagtgctatgatgaaaacaaggggcagaaattactgagggtcttactttagattagatgacagaaaggtctctccgagacagtggtatttaaggagagatggaaaagatgaccaggagcagtggctcacatctgtaatcccaacacttcaggaggctgagacaagaggactacttgagaccaggagttcaagaccagcctaggcaaaatagagactccatctccacacaaaaaaataataattaaaaataacataaaataaagaaaaataacaaaatgggaaacagttatttgggcagaggaaagagcaactataaaggctcagtaatagacacatgcctgtcatgtttgaggaacaacaaagaggctggagtcacttcagcacagagatggatgggacagggacaggtgggtggcaccaagtatggttgggaatatgaagcaggggcctcatgaggcaaagctcttccaactgccccttctgtgattgcatcatcagtctttcttggacgaaaagtttaagaatatgatttgggtttttgtttttgttttttggcctccatccacaatatcctccctgcccatcgtggagttggggctggccaaggcagaagcccattattcctccagttccttcagcagccacagcctgggattggtcttgctgccaacctcctagctgatgcacaggggatgagccctcagcctgtgttcacagaattccttaaagcccttttacctagacatggtccagctttgtgggactgcacttctgctcagtttccttgaaaaacactcctggaccctgtaaaacctggagtctacagaaccttccatgtatttttccaaattccacaatttacaaaaccttgcacatatttttccataggaggcccaaacctcctctttgtatctccttttcttccctgtttcttaaagagattgcccaaggggcaccaactggattggactcttctagtaagcctccttcttggactctaggctctccccttggaaactgcaatattgaggctctaggacctgctagcaagctctggccttgtagatgacagattccggtgtcccaggagcaccagtccatcctaagtccttccttcccagttcagagaaaacccacagtggctaagctgagttctgatgcaggcactacctctttgggttcaaacacaggtctgtacaccccactgctggctgcatagcagacactaggaaaaggcaaatatctatattcccttttttacatttccttgggaatcacttttactaatctccctcacaagacttgcagagcacttggaactttctcaaatggaaagatctctgtatacataatttgatgatctgtaacaacttattcagaaacttcttcattctggttctgagactaatgcattacatacattggatatcacacttgtgaaagtcaggtttaagcagaatatcaagtatattcatggacccccctacacatctgtgagcaaaaccttgtggaaaccatgcttttccaccatcagagaagacctactttaaagcagaagctcttttgggaatcatcaggttgtgtttggcatggcagcaggggcagggacattagaacacaagttattgtcattcccccctcaccaaggcccctaaaagcattggctggctccgttgggcccgtctggttgtcctcaactgtcaagatttggatttgccatttactgacagtgggacttgggtcgtcccctcatcttctgtggcctgaacttcctcaccagtaaaatggggtgagcaatttctactccctggaatcctcagcaggagtgaaagagatgtaacattccaagtgtctgtaccatgccagggcatagtcagaaaatttgtgggctaacgatgagggcaaagatgaatgatactggctgggctcatcagtgctgcgtgacacctacagggagacggactctggtgacccctaacccccaggagaaactggaaaggtacagagatgtccgccatggagcacagcctgtggacagggaaacatgcactttggaggcaggaaggcagcccgatttaagatgctctgcatgagctttaagcagaatctccactgtctagtgtgaattgattttctgagtatctcccccagaaaagagactgttgttctaggtgcaggttttcaaaagaaaggacgtccctttttatacaagctccatgttgcgggaatatcaagcgtctgccaagggacacttag

SEQ ID NO: 1206 - DNA, 10955 bp, Homo sapiens
tttaaaagttaggatgataggtaatgaaggcagaactcttgaatgtggtctagaaggcatgcatggggttgctctgatcacaaagggatgctatttatatgggagaaagggaatgtattaggattagatatttagctggcagggggactctcttgtcagtgaactcagggaggacactgtaggaaagagatgacagaaagagggagagactgcagagcatttatttattttgtttaattacaagcgtgagataagccagcaacacattacaacccgggggatcagagggtccctctgagacagactgcgggagccacatctggttgctacagtaacgggcctccttataacgagaagagccacaagtgcccgacataaatggcttggggcagaggagcaacaagcggcctaccttgctgcctcttggggaaggcagtctcggggaggtttcgcagtgggtaaagaatgagactctcgtggggagggtctcgggttgtcttgagtctaggagcttgagggcctctccgggtcttactgatgaggtcgaacatagggaaaggaagtcctcctggcttcacctgtgctgcctgcgagcccttactgcatgggaggagccccaggacaagaaggcggtacagcagcttttttgaactggcttgggatgctgagagatttgggcatcccttggccatcctgaggagggccaggcccacatgatgggatcagtgcaggggggggtggtcactggggccctcctgtggtccttcttgccggcgtcacccctgtagctgcaggaacttgaaacccctgccccaaacttgcattctccttcctgccccagtatgcctcctccttgctttgctgttccctgtgcctgtgagtttctctccctcttgtcatctagttcatgcttcttatcctggaagggtcaccaaagggtcttttccttcctgctgggtcatgtgccccttgaataagctcttctgtcactgtgtgactttttagtagcattttcccaattgatatctggtattttcaaggccatttgatagttccctacactggatggtgagccccaggtggggaggggtggtgtttggttttgtccatcctgtgtcctggtgcctactgcagtgcctagatacaggaggtgcttccagaatgattcttgagcaaacaaatgaatgagacagtccccagctgtttgtgtaaacgagtgaattcccacgactcgttttgggcctggttttttttcccagtgcagcagagcacagggaatgaaggggagaggagggcctggggagcggggatgtggggtgtgcgtgtgaaccatgggaggaagcctgcgttttattccaagggacacagggaccgactggagggctttgagcagaggagtgatgggatctgacctacattgctaaaggatcattgtggttagtgtggaaagattagccaggtggagggagagggctgaggagaggatggaggtgaattagaggggtggtggcatctggaagattgggctggactgggatctgtccggaatgtagagcccacgggtgcagcgttctgggcgtcaggatcccgtgatgtgtttgttgctctgatccgtgctgtaacttttcacaggtgagctatgctggggccctgagtttcccacattacaacacacacacaacttttcaatcaacaaacctttgctgcccccaaagccaccccaggagcccctggggcccatgtgtgccagttgaggccacggtggccccacctgcagctggctggccgttcagactcctgctgctgctcccgctgcctccttccatcacagatgatactgagttgttaccagtcaagacagggaaaaggcaccctcaaagcctcagctcttcaacctgccgttctgggcctccgccatccaccgccactcttgttttccagtgccattttgcacaacttccaccgtgctcgcgcgctgtggccaaacagcactactccttgcctgcttttgggggtgctcctcttctcacctggaatgccctctcctccagttttcacatgtcaacctcctacccatccttcagagttgtattagtctgcttggtcgctcacaacaaagtaacacagactgtaggtcttaaacaaaagacattaattttctcacagtactggaagcagacattggagtcaaaatcaaggtgttattttgggaggttgaggcaggagaattgcttcatcccaggagtttgagaccagcctgggcaacacagtgagaccccatttctcaaaaaagaaaaaaattagccaggcgtggtggtgcgcaccttgtcccagctactgaagaggctgaggtgggagggttgcttgagtgttgagtttgaggcttcagtgaggtatgatcatgccactgctctccagccttggcaacagagcaagaccctgtctcaaactatatgtgtgtatatatatatatattcaccttgtatcttcacatggttatccctctgtgtgtgcctgtgtcctaatcttttcttatatggacatcagtcatactggattagggctcaaccatatgacctcattgcaccttaattaccacttgaaagaccctctctccaaatacagttacattctgagacattaggggttagggcttcaacataggaagggagtggcggggagggacacagttcagcccatgactagagtctcagtgagatgccactttcccctccagcacccactgtgctcacacaccatagcctgttagtgggcttctttctagcactggttgctgtgtcctttggtgttcgttcgttcgttcgttcgttcgttcgttcgttcgttcgttcgttcattcatccatctaaaaatagtactaagagacatctagtccagactcctggactgtattattctttgagtcctgaccacaccaactatatctgacacaggtcacctgggacatttaattttttgttaattcatcaaacaaaatttctgaacacttctcatatgtaaggcattgatccagatgctaggcagcaggcacagcagaaggggtctgaatgccagccagctgctggtggggccactgatttgcctttccttttaaatgcaaaggcgaatcagagttggcacttccagttagttggagagacataactggcatatacagtcatacaagagaggacatagacaaaatgcttggaatttagagcaacaccaaatcacatttgtctttgtaggtgtggggagatggcagataagactacaagggtgaactgacatttgatctgggacttaaagatgggtaagatttgtgtagataggtggccttttgagtttaggcttttttcacttagcatagtgcatttgaaatacatcctttttgtgtgtgtgctattcattcacttttattgctgagttcattctttctattgctgagtactagtctaatgtggggatgcatcagtttatgtatccactcactgttgagggagagttaggttgcttgacttttgctgttacgaaatcaagctgccatgaacattagtgttacagatgtttgtgtgaatacaaattttatttctcttggataaatactgaagagtgggattaatggattgtatatgtttaatttttaagaaacttcagcactgcaaagtggctgtaccattttgcatttccgccagcaatgtattagagttccagttgctccatatccttgccagcacttgatactgttttgttttgtttttaaatttttagccattctagtaggtgtgtagtgatagctcttatggtttcaatttgcattttcttaatgactaatgatgtcaagcattttttcatgtgcttatttgccatccaaatatcttgtgtggtgaagtttttatttaaatatttggtcattttttattgccttgtgcagtttattattattatttgttattaatatggacatcatttgttatttttaacaaaaataacaaagaggctgggcactgtgactcacgcctgtaatcccagcactttgggaggcgaggcgggcagatcacctgaggtcaggagtttgagaccaacctgaccaacatggtgaaaccctgtctctactaaaaatataaaaattagtcgggcacagtggagggcacttgtaattccagctactcgggaggctgaggcaggagaattgcttgaacctgggaggcagaggttgcagtgagccgagactgtgccgttgccattgcactccagcctgggcgacaaggggaagactccgtctcaataaataaaaaataaaagtaacaaataataacaaaaatggttattattcaagaattcaagattcaagtcctttatcagttttgtgttttgcagatatttcccttccagttgatggcttgtcttttcattttgttgacaatgtcttttgaagaccataagttttaaattttgacagtatcccattaatcaggtgggtttttttgtttttttatcttagttattttattgctcatatttttggtgttgtaactaagaaatctttgccttactcgaggtcacaacagttttctcctgttttcttctagaggttttctagtttcaggtttcacctttaggtcaatgggctgtctttaatgtggaccagacactgggcccacaggtgtggaaccacagaggaatgagacagagcccttcactcagggaccatctgggcaagggaggtgggggtgggagtcacacagggaaacagtctttgtctggtgtaaggcctgctgataagcctgggtccagggtgctgtggacacactgtggtgtggaagcaggtctgtgcccagacaaggggctgtgaactgaggtttaccagacagtagagggtaagtgaaaagcaggagttcaggctgggaagcctgttctgggcttagagtggccttgggcaggcctggaggctggatgatagaactcagcatccctgcagctgctggtcatttgctgtgcctggggtcaaagtgcaagacagctggcaggagtgggcagaagggagcaggggcctgagcacttggtgtgccttatcctccaacaaagaggaggtggaggtggcttcatggcatggctcaggctgtgctctttgagggtcgggggtaactgtccctctttattttgaaagtcagatgtgtctgtgtcataaagggcacatccatagggggcagcggaagtgctgttacataaccgtttctgtccctcacgctggaaacagatcgcacagcagttgctgtacttgctgttccttgtagacttactcctgtgcaaggaacgtgtaatgacaaggtaatcccaggagcagcctgcaaaattatccgtcgtatttgtggttcctgtgtatatttaaaacacaatgctagaagcgattgatgctgacgaaggatagggcatattccaggcactgaataaattaaccctgcaaagcacagcagttgctttcattagccagctggcactgcaggaatattgctaaagcctgtgggttagaaaagaaaatctcaggaatgcgagaacaaaaaagaaatcagccacattcagtgatttaacttaatctggcaacaataaggaaatccagaactcacggtgctctgagcaatggcggactcccgctgcatgtgcgagtggatggatattccctgttcagtggaggggatatccaccacgactctgggtacccacggcgggatgcagatgtgagttagggccatgcggcgatgatccaggttttgttcctgcatcctctgcaactagagaagctccagcaaagttctgtgttcccctcttttcttcctgatgtccccaaggagtgaagcaaatgaataggcctagctaatgtgccatctctctctcccttctctacctggccaggcactttctgggatggctgctgccatcatgtccatgacactgaaggcctctgctgcctgcagtcccactgctgcctccgccaccctgggcaccactgctgccttgttgccctgtggctgtgaggtgccatagtgccaagtcttcagcacgccccagaagccatgatgagtatggtggaggcctcagaattttcctggggaagtagctctttccatgttgccttgatggccctgttcccacctcctgtctctccccctaggccaagtgttatcccaggagacccttcacttccacagacagacagacagactgccagggaccctcctcagccagcctcttcacatgccgaggccacagcactcagtgtggttgggtccagttgagaccctgctgctcatgacttaaggcttctgtgcattgaattaagccactaggggacttatgagatcaccctctggcttctcttgttgggtcccatacagccagtatgtgtcaccaggggcatgtggcatgtgtagcctgcctctcctgagtttgcagagctgggctggctcctccttgattttatcttcctctggaccagagtggctgaagtatagtgagcagagggaggggcagtggacgtggtgaggggccagacctctccatccatgggtgggggctctcgttatggagggtcccttttttgcgtctgtgctcagcagtgcgggggaagagggtttgtccccttcctcccaggtcctcatcgttcaaatgcacggaagcatgttggtagagcacacagaggttttgctgggtgggtggggcagcatgccctgcagttcttgcattgtttccagaggaaatagaatagaatgcaacagaactggcctgcctgttgcctgggaagctgttctcctgacatcacagggctgtgcccatatccccgcttggcttaggggcccctaagttaggaacaaagaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtga

SEQ ID NO: 1207 - DNA, 3872 bp, Homo sapiens
ttttaagaagaaagaacggagaaaatgatgtctgtgtttcaggccataatactgagtctcagagaagaaggccataagtgacaagttcagcccagaacctggctttctgctttttcattgttacctctcctacacctgttgttctcatacaggcctttaaaagaaatccctttactgttcttttttttttttttttttttttttttttaaacagagtctcactctgttgtccacgcttgagtgcagtggcgggatctcagctcactgcaacctctgctcccgggttcaagtgattctcccgcctcagcctcctgagtggctgggactacaggcgtgcaccactacccctggttaatttttgtatttttagtagagacggggtttcaccatcttggccaggctggtctcgaactcctgacctcaggtgatccacccacctcggcctcccaaagcgctgggattacaggcatgggccactgcgcccagcctctttactgttcattcagtggggcttggggatggagcaaacaaaaacaaaaactgcatgtgttcaggctgccacttttacctggatgcctacactccccatgtgacagattagtcccaaatcccatttggtccctccccagtagttcagcctctagtccttcaacttcatctcataagagctctcctgctcctggtccttcatttgccaaggttctcataaccacacaggtgctccagacatggccagaccagccagggcatgaacaggaggtaatccacagggcaggggaccatgctgctacaaatgggctagcagtattcagtaaatgttcactccgtgctaggcactgtggagatggtcagggattccccgagccaaacttctaacccctttgggaaaagaaaacacactcgtgtgaaaagttagatgccaattagggtttttccaagtaggatacacttgcaaaatgagcaatggaaaggaacagaacatagaaaatgtgacaaaaccatttcacaggcattaccttttaaaaagcaggctattaaaattggggatgactatagaaaacaagtcagagaacagaaagaaaagccatacactaactcatcaagagtgattgtctttgggtggtgggaatgtgggtgatttttttttctacttttctacattttcctttttttttttttttttttttgtgagacggagtttcgctcttattgcccaggctggagtgcaatggtgcaatcttggctcactgcaacctccgacttccaggttcaagtgattctcctgcctcagcctcccgagtagctgggattacaggcatgtgccaccacacccagctaattttgtatttttagtagagatgggatttctccatgttggtcaggctggtctcgaactcccaacctcaagtgatccgcccacctcggcctcccaaagtgctgggattacaggggtgagataccgtacccggccttccattattttctacaacagatttttatcactcttatttgtttagtttttaaaagcactattattattttttgtttcaaaagcagtacaggatcattgtgaaaaaacccaacaattcagatttaaaatttttattgtataatacagaaagtagagatccttttaatttataatatatgtcttggtttttgtttgtttgtttttgagacaggttcttgctctgttgctcaggctggagtgcagtggcgcaatctcagctcactgcaacctccatctcccgggcacaagcgattctcccacctcagcctccagagtagttaggattacaggtgtgcgctaccatgcctggctaatttttgtattttttgtagaggcggagttttgccatgttgcccaggcttgtctcaaactcgtgggctcaagtgatcctcccgcctcagcctcccaaagtgctgggattacatgtgtgagccactgcgccaggtgcaatgaatcttataagtggctattgcctttgctagcatcttggaatctttgtctttgggactgttacaagattcgggatgtgaggcttatacccgctgtggtcttgtttccccgcacctaggctgttgcctgggtgggccagagaagagctctagactgccgtgcggtctcctatgggaactctctgtagagaaatgctggaggccctcccgcagacgcactctttcctgtccctgcatccttctaggcaaagccagtgccatttatgtcctatttgggtcttgtgagtctaacatctggttgagccaaagaagacccccagagggggcactgcaggagataataccaatatcttcctccccaggatgaaaggtttaaatgagataatatacactgagttgctgtcagaggacgtgacaagtgtcagctcccttctctccatcccaaaaaagaatacctggttttggggtcttctcgttttttccttggtggagaaaggcctgcttctggcttccagtctgaacactcaagccctttttccttcttctttgccttttctctttcctctcctttttctccttttgggggtccaggggagtctgaaaacaaaagggtggcattgtccctcagctaagctctgtctcagcagaacccagcatgacttagtggggagagagcaaagggcagggacgaggacagctgcacacacactcccaacacacacacaaacacatttacacacaaatgcacaaacaacaggaacgtgtgtacaaatacacagtctcacatggggacattaatacattggcaaacacatctctgcacatattaagacaaatgtgtgcatgtagacatgtactatatagacaaatgcatgagagcacaaacacgtaagtggcacatgtacacaaaactcacaagtctacaaatcttgcacttgtgtacacaaacattggcagtcccccactagctacctcccggatccagaggccatctgtcactgattaagtcactcaacagacatacactgagtgctggctatgagccaggcccagtcctgtcccaagtgctaggagaaaaacagggctcaagacaaccttgtcctctctcacctagcagccgcttccagtttttgataaggactttggccaaggacaccacctccttgtctgagcagtgcttgcggaccccattaacagcaactccaatcctggttgtctgcaaagtgagagggttaaggcataatctgggaatggatacacaggaatggctgccatcattggcagatcctgccccagctctaccaccacctccccttccaacctggacccccagagtcctagccctgactcctggctgaggtcagaaccccactactgtaactaaggccctgctctgcacgaggccgagggcccagggctaagcctgacatggaggatatctgtagctttggtgaaacctgaacctagggttgggggtggcacttggctgactgtcaggacccctcccattcccaaccctctagtgtctatttttttgagatggagtctcgctatgttgcccaggctggagtgcagtggtgcaatctcagctcactgcaacctccacctcccaggttcaagcgattctcgtgcctcagcctcctgagtagctgggattataggtgtgcatcatcgtgcccagctaatttttgtatctttagtagaaacggggtttcaccatgttggccaggctggtctcgaactcctgacctcaggtgatctgcctgcctcggcctcccaaagtgatgggattacaggtatgagccaccgtggccagctcactctagtgtctttgagctccagtttcaactgagacagcagctccggctatgagaccttgcatctgtctgtgctgatttttcagggccaggagc

SEQ ID NO: 1208 - DNA, 7695 bp, Homo sapiens
aagttcattcctagactggccatttatagtcatccagtagatactccatcattccattgtcactcttccacctgtctgtccgcaggagctccgaattctgcaacctccgcctttccgtgtgtagctcaagcagaatccagagagggcatgagcagtgggtaacaagggcagagtgtttgcaaacccaggaagaggtgacggcacaggcaattagaggcagaaccctgattaactgagcccaactaaccagaaccatcaattaactcaaatcttttttttttcttccctctcaggagactgaggccaggaattgagaaaatcacaatttaaaatggaaaaaaaactgtgttccgggcttttctctggctcaactctgacccaggtccatttccttcatcctcattcaagacacatgtacaacttcaaattttctagtagctgtgttttttaaaaaagtaaaaagaaattgattaatctatttgatttaaccaaatacatcctaaatattgtcatttcatcatgtgatccatatggaaaaagtatcaaatctaaacaaatatgaaaaagcattaaggagatgttttatattcttttgtttgagctaagtttttcctagagcacagctcagttggaactggctgcatttcaagtgctcagtaaccctgtgtggctggtggctaccatatgggacagcacagatctggagctaaagtgtgaagtgattgtttagaatgatgattctggagggttgctagggtttcaacgtccatgtcacctccaaaattcatgttgaaattaattaattaattaatttaatttattttttttttttttgagatgaagtctcactctgccgcccaggctggagtgcagtggagccatctgggctcactgcaacctctgcctcccgagttcaagcaattctcctgccccggcctcccaagtaactgggattacaggcatgtaccaccatgcctggcccatttttgtatttttagtagagatggggtttcaccatgttggccagactggtctcgaactcctgacttcaagtgatctgcccacctcggcctcccaaagtgctgggattaaaactgtgagccacacgcccggcctcatgttgaaatttaatccccaagggaagagtattaagtggtgggtcctttaggaggtgatcaggccagaagagttccgctatcatgcatggggttagtcccttacaaaaggtatggagagaactaagtaaaccccttttgcccttccatccctttcaccatgtgaggtcacagagttcatcccctacaaataatacagtgacaaggcaccatctcggaagcagagagcaaccctcaccagaccccaaacctgctggcaccttgatcttggacttcccagctttcagaactgtgagcaatacatttctgttgcctgtaacttactcagcagcataaacaacttaggccggggctttaaaacaaattggtcactagtgagtaactgcgtgctaagtgtttcctcccaacagtgcctcatgattgacaaactggtcttgggcttacacgggtctatgacgtcctggagtacagactgccaagtcccttctctacagccagggcctttcttcacaggaaagtgactgcagtaagagccacctgccatgacctccaccccattaattacctctttgtctgatttgcaatatgcaagccttctccataccttccacctaaatgatgaattcacacttcagaccaaaaaaaaaaaggaaattatttgaaaaggccatttttctactaaccacccaggaatgtgtaggtgtagcatttaatagtgcctacaaagtccctccccgaggggaccttgcagtctagcaaggacagtgagaagtacacatttaaaaaaagatctactattatcctggctaacatggtgaaatcccgtctctactaaaaatacaaaaaattagccaggcgtggtggcaggtgcctgtagtcccagctactcgggaggctgaggcaggagaatggcgtgaacctaggaggcggagcttgcagtgagctgagatcgcaccactgcattccagcctgggcgacagagcgagactccatctcaaaaaacaaaaacaaaaaaaagatcaactatttatgggtccaataaaaactagctactgggccaggcgtggtggttcacacctataatcccagcactctaggaggctgaggtgggtggattgcttgaagccaggagttcgaaatgagcctggccaacatggcataaccccatgtctactcaaaaatacaaaaatcagccgggcatggtggcgggtgcctctaatcccagctactcaggaggctgaggcacaagactcaactgaacgcggggacgttgcagtgagctgagattgcgccactgcacccagcctgggcgacagagtgagactctgtctcaaaaaaacaaaaaaacaataacaaacaaaaaaaaaactacctactggccacctggaacaagggttaaccaacatatgaggcagccccttttattggtgagaaaaccgagatcagaaaaatgaatgaattactatccacatgctcccacaggaactgcagaagagcgcagcccagaacacaggaagccttcccattttaaaatcattcatcgagtgtaatcccagcacttcgggaggccaaggcaggcagatcacctgaggtcaggagttcaggaccaccctgaccaacatggagaaaccatatctctactaaaaatacaaaattagcggggcatggtggcgggcgcctgtaatcaatcacagctactcaggagggtgaggcaggagaatcgctttaacccggaaggcagaagttgcagtgagccgagatagcgtcattgcactctagcctgggcaacgagagcaaaactccatctcaaaaaaaaaaaaaaaaatcattcattgagtaacttttccattttttgccctatccatgtaatgtctgttgttttatttatttttcagggctctttaaatcagctcatctatatttttacttcaatggcttaatttaaaagggaaacattactcctaaattagtggaaaaactagtataatttgctataaatggaaggtaactagaaaaataaacagagagctattaatttctataaagtctgtggagttatagcttaaaatcatcttgtgagtcaccagtttgcatgtgacactttggaaaaggctgcaacagagaagttgagacctacgctttgcctggctggctggcaagactttgtaaaggaagaagaggaaaggtgtcccaggtgtgtgcacagcatggagaaacgtgcggaggtggatggagggcagagcgtggaaggcagagaggaaactgatacctacctgattaaatcaccgaagcacattcagttccgtgccatggatttaacatggactaacacactttggaaatactttcaaagcaaggtctgcaacaatagtgtttttgtaactcctagttaacaagaaaaacaacagatccaagcccccacggcggttccccagtgtttcccaatactgtcatctgattctgttttctgtcagggaaataaaatatcccatttcctccatgatggtgagttctgaatgcagctgtccacggtcaggggagatggagaggaaagaagccaaaaagcagcaggcaggcaaaggccagtgagaagatgttgactctggggccccgtccttcactactgtgtggttgcgggtgtgggtatggatgtggatatggatgcgtgtacagatgcaggtgtgggtgtgcatgcatgtgtgtgagagagaaaacctcctcctcctaggctcaccccaggccatcaaagagacacacataccttgcagaaagtcaacttctacactggttggggcaagtccagcccgtccgaatcccacagggaagggccaccatggcttctaccccagccgagctgacatccccaaacacagggactttcgtatgtgtgtccgactggccttgctccctgccagtggctgcctcttcaggggccagaaaccctgatcgtgtcaagcagtcctagaaaaaatgctcacccgctttctcagatgaagtgcagtagggctccctggcctgcacaagccagtgaccatttttttaaaagcccttggaaaagaaaggcatatattctgcaacacaatatttggtggacactatcatagcattttgtaagatcgtatgtaaccccaactgtggctctgaacaaaaaaatattattcagccccagaaaggcatataaatccctacaaagtacagggtgggttttttgggtttttttaagtggttaaattctcacaattttttgcctttgttcagtgcagggagacagtggtctgcaaaggtggtaacactgacttcctgagaatcttttttctttgagacagggtcttactctgtcacccaggctaaagtgcagtggtgcagtcatggctcattgtagcctccacctcctgggttcaagccagcctcccacttcagcctcccaggtagctggaactataagcacatgccaccacacccagctaattttttatagagatgagagggggtctcactgcattgcccaggctggtctcaaactctagggctcaagcgattggccagcctcagcctcccaaagtgctaggattacaggcgtgagccaccatgcccggcctcctgagaacctttaattgaacttgcagcattgcaattcagcccaagctccttgggtgcaggacttcacgttgctaaatccagggaagcctaccttggttacctgggaaaatggtgtgggaggttccttagatctctccctagccacctgctccttaaaaacatcacaagaggttgtgggaccacaaacccttgtctccgagaattccttcttctctccaaacttgccctattcacacattcccgatcttattttttcctgagtcctactttgtctgttccacattttttctttttctttttttttttttttgtgagacagagtcttgctctgtcacccaggctggagcgcagtgacgccatctcggctcactccagcttctgtctccagggttcaagtgattcttctcagcctcccgagtagctgtgattacaggcatgcgccaccacgtccggctaatttttgtatttttagtagaaacggggtttcgccatgttggccaggctggtcttgaactcctgacctcacccacctcggcctcccaaagtgctgggattataggcgtgagccaccgcacccggcccccgttctacattttaatggccctcaaatctgtcccctcctttcctttcccactttccctgtcccagttcaggcctttatcataactcccctgaactgaatgtccccttttctgattccttgcctctaggctcacttctgcaatccattccccacgaagcagccagagtgatcatctcaaactgatcttggaccatgctcttctgctcctcaaacatcttcagtggctccccattacctacacgatacatctgaagctccctgatgtggtctacagtacctgggcctgtgcctgccttatcagtcccatcccctgccaaggcctgctcctctcttttacatctgacactttggaaaaggctgcaacaaaggagaagttgaaacctacgctttgccgggctggctggaaagactttataaaggaagaggagccttgtgctccatgaatattgtatttcttgtgattttctgacaaggctcaatattttcatctctgttctctgtcgggaatggtctttcgtgtccccttatcctggtcattcgtggcctgctcacattcacccttttttttgggacggagtctcgctctgttgcccaggctggagtgcagttagttcaagcaatgctcccgtctcagcttccaaagtagctgggactacaggtgcccaccaccacaactaactaatttttgcatttttagtagagacgggctttcaccatattggtcaggctggtcttaaactcctgacttcaggtgatccacccacttcggcctcccaaagtgctgggattatcattcacccgttaaggtcatgctgtgggcaacagctcctccaggaagccttccaggagtgttctaggttatactgcccactcctacatgatcacagaactgataacactccgcaagggagaaacatcagaaatctatcttacaaaaattcaactataaacagtcaggagggaaaaaagagagagatagatggtgacacaaatcatttaaataatgtggaatcctgtgcaccacttgactctgtgagtatataccctgtgatgaacatcttgctatgatttctctctccatctagcccagagtcatttttctggaatctgtgagtttggggatctatggagagagaattctgggggtcttcgaacttgtacatacccgctgatgaacttgtacatattcataattattttcactaactctaactgaaatttagcatgaccttcaattatgaatataggcaacagactgcagtagtattagcaacacccgagactttgacaccaacagaaattgcagatattttcatgtcacattgctttggtggcagatgtctccaaatattgtttatacttgtcattacttcaaaattagggtagttattagacctgatgccaaatctactttaatgtgttaataaagaagcaaatgtattattactccacagttttctgatttttatatatactttgacggctgtacttcaatataaccactttcctttttaatcctctgcatttttttgcatttgaaaatattcagagaaggggagcataattttgaccagattccgaagggatttacaacacagagaaggtgacactatcctgctgtagacagtgagctcactggtggcagggcaccaggtccttcatcttccaatccccagcacctaaagcagtggttagtatacaataggaatttttaaaaaatgaactgagatattttatctatctatccttttttccctccttccttcttccttccttccctccttccgtcttttctcccttccatctgtgtatccatcatcatccatccatcacctatccatccatccattcatccatcctccatccatcatctatccctccatcatacatccatccatgatgcatccatcaccccttgtccacccatccctctatccatccacccatccctctatccatccacccattcgtccacccatctattatccactcatttatctacccactcacctctctatccatctgcccacccatccacccacccatcctgtatccactcatccctctatccatccgcccatccctccatccaacatatatccatccatctgattcaatctacagttctaacagttgacacctctgcagttggtttcccagatccagttctgcagctcaactggagactccctaagaaggaaaagtgactcactgtggaaagaggtgatactatttccttgtatggccgtgggcatgtcacagaatgtgcctgcagctcagctgtctttcacaggctgaacacagagctctgtctccagctgccaccacatgggctggggccccaagctcaggcagagcgccatgcctgtgttcagatcatttccttacccaggaaca

SEQ ID NO: 1209 - DNA, 8894 bp, Homo sapiens
attaaaccaccctttttgagaggataaatgtgtggtgggtctgtatatgttgatgacagacagatacacacacacatatggtagatgttaacgagcccattttattgatgggcacactgaggattgaccaggtgaatgacttatctcagattgagtccacagccaggactcaaaccaagatataattccactgtccacttttccccaccacactgtggtataaggcctaaaattaatattatgtgctgccttgacacctggggaaagccaagagcatctcatatggcttgaatgtaagtttccctaactactttgcttcctcaaataaggtcctctagccagacagcctcctttgtctcagcaagaccaggtacagtgcctgcctatccctggagagtgggtttctgttccctgccagcctctgggattatttaaacaagacaatcatatccccttgtgggacacagggattattgcatcttcttgcttctgcatagcctgcctcccatggcccctggatgttcaccctgtccccagatacaaccgtgtggccctgcatggtgcacagcacctgcttccctggggctgactgtacgtgacacataaactgctgtccatctggtctgtccagctttgggtgttatccccatagggtgggaatctacttcaaccatggggtgaagtggaggcgatcaaaacacacaccaggctgggtgtagtggctcatgcctataatcccagcactttggaaggctgaagcgggcagatcacttgaggtcaggagtttgagaccagcctggccagcatggggaaaccctgactctactaaaaatacaaaaattagccgggcgtggtggtgtgctcctgtaatcccagctactcgggaggctgaggcagaagaatcacttggacccgggaagcggaggttgcagtgagccaagatcgtgccactgcgctccagcctgggtgacagagccagagtccatcacacacatacacacacacacacacacacacacacacacacacacacacacacggcttcctgagcaaagtgggactattacaatttccacagaatgatattccaaagtccctctctagaggtcagcttgcaacacacctccccacaggtggacactggtcagttttggaagagacaggagccaaggactctggccttcagataactaaacctcaagttcattcctagactggccatttatagtcatccagtagatactccatcattccattgtcactcttccacctgtctgtccgcaggagctccgaattctgcaacctccgcctttccgtgtgtagctcaagcagaatccagagagggcatgagcagtgggtaacaagggcagagtgtttgcaaacccaggaagaggtgacggcacaggcaattagaggcagaaccctgattaactgagcccaactaaccagaaccatcaattaactcaaatcttttttttttcttccctctcaggagactgaggccaggaattgagaaaatcacaatttaaaatggaaaaaaaactgtgttccgggcttttctctggctcaactctgacccaggtccatttccttcatcctcattcaagacacatgtacaacttcaaattttctagtagctgtgttttttaaaaaagtaaaaagaaattgattaatctatttgatttaaccaaatacatcctaaatattgtcatttcatcatgtgatccatatggaaaaagtatcaaatctaaacaaatatgaaaaagcattaaggagatgttttatattcttttgtttgagctaagtttttcctagagcacagctcagttggaactggctgcatttcaagtgctcagtaaccctgtgtggctggtggctaccatatgggacagcacagatctggagctaaagtgtgaagtgattgtttagaatgatgattctggagggttgctagggtttcaacgtccatgtcacctccaaaattcatgttgaaattaattaattaattaatttaatttattttttttttttttgagatgaagtctcactctgccgcccaggctggagtgcagtggagccatctgggctcactgcaacctctgcctcccgagttcaagcaattctcctgccccggcctcccaagtaactgggattacaggcatgtaccaccatgcctggcccatttttgtatttttagtagagatggggtttcaccatgttggccagactggtctcgaactcctgacttcaagtgatctgcccacctcggcctcccaaagtgctgggattaaaactgtgagccacacgcccggcctcatgttgaaatttaatccccaagggaagagtattaagtggtgggtcctttaggaggtgatcaggccagaagagttccgctatcatgcatggggttagtcccttacaaaaggtatggagagaactaagtaaaccccttttgcccttccatccctttcaccatgtgaggtcacagagttcatcccctacaaataatacagtgacaaggcaccatctcggaagcagagagcaaccctcaccagaccccaaacctgctggcaccttgatcttggacttcccagctttcagaactgtgagcaatacatttctgttgcctgtaacttactcagcagcataaacaacttaggccggggctttaaaacaaattggtcactagtgagtaactgcgtgctaagtgtttcctcccaacagtgcctcatgattgacaaactggtcttgggcttacacgggtctatgacgtcctggagtacagactgccaagtcccttctctacagccagggcctttcttcacaggaaagtgactgcagtaagagccacctgccatgacctccaccccattaattacctctttgtctgatttgcaatatgcaagccttctccataccttccacctaaatgatgaattcacacttcagaccaaaaaaaaaaaggaaattatttgaaaaggccatttttctactaaccacccaggaatgtgtaggtgtagcatttaatagtgcctacaaagtccctccccgaggggaccttgcagtctagcaaggacagtgagaagtacacatttaaaaaaagatctactattatcctggctaacatggtgaaatcccgtctctactaaaaatacaaaaaattagccaggcgtggtggcaggtgcctgtagtcccagctactcgggaggctgaggcaggagaatggcgtgaacctaggaggcggagcttgcagtgagctgagatcgcaccactgcattccagcctgggcgacagagcgagactccatctcaaaaaacaaaaacaaaaaaaagatcaactatttatgggtccaataaaaactagctactgggccaggcgtggtggttcacacctataatcccagcactctaggaggctgaggtgggtggattgcttgaagccaggagttcgaaatgagcctggccaacatggcataaccccatgtctactcaaaaatacaaaaatcagccgggcatggtggcgggtgcctctaatcccagctactcaggaggctgaggcacaagactcaactgaacgcggggacgttgcagtgagctgagattgcgccactgcacccagcctgggcgacagagtgagactctgtctcaaaaaaacaaaaaaacaataacaaacaaaaaaaaaactacctactggccacctggaacaagggttaaccaacatatgaggcagccccttttattggtgagaaaaccgagatcagaaaaatgaatgaattactatccacatgctcccacaggaactgcagaagagcgcagcccagaacacaggaagccttcccattttaaaatcattcatcgagtgtaatcccagcacttcgggaggccaaggcaggcagatcacctgaggtcaggagttcaggaccaccctgaccaacatggagaaaccatatctctactaaaaatacaaaattagcggggcatggtggcgggcgcctgtaatcaatcacagctactcaggagggtgaggcaggagaatcgctttaacccggaaggcagaagttgcagtgagccgagatagcgtcattgcactctagcctgggcaacgagagcaaaactccatctcaaaaaaaaaaaaaaaaatcattcattgagtaacttttccattttttgccctatccatgtaatgtctgttgttttatttatttttcagggctctttaaatcagctcatctatatttttacttcaatggcttaatttaaaagggaaacattactcctaaattagtggaaaaactagtataatttgctataaatggaaggtaactagaaaaataaacagagagctattaatttctataaagtctgtggagttatagcttaaaatcatcttgtgagtcaccagtttgcatgtgacactttggaaaaggctgcaacagagaagttgagacctacgctttgcctggctggctggcaagactttgtaaaggaagaagaggaaaggtgtcccaggtgtgtgcacagcatggagaaacgtgcggaggtggatggagggcagagcgtggaaggcagagaggaaactgatacctacctgattaaatcaccgaagcacattcagttccgtgccatggatttaacatggactaacacactttggaaatactttcaaagcaaggtctgcaacaatagtgtttttgtaactcctagttaacaagaaaaacaacagatccaagcccccacggcggttccccagtgtttcccaatactgtcatctgattctgttttctgtcagggaaataaaatatcccatttcctccatgatggtgagttctgaatgcagctgtccacggtcaggggagatggagaggaaagaagccaaaaagcagcaggcaggcaaaggccagtgagaagatgttgactctggggccccgtccttcactactgtgtggttgcgggtgtgggtatggatgtggatatggatgcgtgtacagatgcaggtgtgggtgtgcatgcatgtgtgtgagagagaaaacctcctcctcctaggctcaccccaggccatcaaagagacacacataccttgcagaaagtcaacttctacactggttggggcaagtccagcccgtccgaatcccacagggaagggccaccatggcttctaccccagccgagctgacatccccaaacacagggactttcgtatgtgtgtccgactggccttgctccctgccagtggctgcctcttcaggggccagaaaccctgatcgtgtcaagcagtcctagaaaaaatgctcacccgctttctcagatgaagtgcagtagggctccctggcctgcacaagccagtgaccatttttttaaaagcccttggaaaagaaaggcatatattctgcaacacaatatttggtggacactatcatagcattttgtaagatcgtatgtaaccccaactgtggctctgaacaaaaaaatattattcagccccagaaaggcatataaatccctacaaagtacagggtgggttttttgggtttttttaagtggttaaattctcacaattttttgcctttgttcagtgcagggagacagtggtctgcaaaggtggtaacactgacttcctgagaatcttttttctttgagacagggtcttactctgtcacccaggctaaagtgcagtggtgcagtcatggctcattgtagcctccacctcctgggttcaagccagcctcccacttcagcctcccaggtagctggaactataagcacatgccaccacacccagctaattttttatagagatgagagggggtctcactgcattgcccaggctggtctcaaactctagggctcaagcgattggccagcctcagcctcccaaagtgctaggattacaggcgtgagccaccatgcccggcctcctgagaacctttaattgaacttgcagcattgcaattcagcccaagctccttgggtgcaggacttcacgttgctaaatccagggaagcctaccttggttacctgggaaaatggtgtgggaggttccttagatctctccctagccacctgctccttaaaaacatcacaagaggttgtgggaccacaaacccttgtctccgagaattccttcttctctccaaacttgccctattcacacattcccgatcttattttttcctgagtcctactttgtctgttccacattttttctttttctttttttttttttttgtgagacagagtcttgctctgtcacccaggctggagcgcagtgacgccatctcggctcactccagcttctgtctccagggttcaagtgattcttctcagcctcccgagtagctgtgattacaggcatgcgccaccacgtccggctaatttttgtatttttagtagaaacggggtttcgccatgttggccaggctggtcttgaactcctgacctcacccacctcggcctcccaaagtgctgggattataggcgtgagccaccgcacccggcccccgttctacattttaatggccctcaaatctgtcccctcctttcctttcccactttccctgtcccagttcaggcctttatcataactcccctgaactgaatgtccccttttctgattccttgcctctaggctcacttctgcaatccattccccacgaagcagccagagtgatcatctcaaactgatcttggaccatgctcttctgctcctcaaacatcttcagtggctccccattacctacacgatacatctgaagctccctgatgtggtctacagtacctgggcctgtgcctgccttatcagtcccatcccctgccaaggcctgctcctctcttttacatctgacactttggaaaaggctgcaacaaaggagaagttgaaacctacgctttgccgggctggctggaaagactttataaaggaagaggagccttgtgctccatgaatattgtatttcttgtgattttctgacaaggctcaatattttcatctctgttctctgtcgggaatggtctttcgtgtccccttatcctggtcattcgtggcctgctcacattcacccttttttttgggacggagtctcgctctgttgcccaggctggagtgcagttagttcaagcaatgctcccgtctcagcttccaaagtagctgggactacaggtgcccaccaccacaactaactaatttttgcatttttagtagagacgggctttcaccatattggtcaggctggtcttaaactcctgacttcaggtgatccacccacttcggcctcccaaagtgctgggattatcattcacccgttaaggtcatgctgtgggcaacagctcctccaggaagccttccaggagtgttctaggttatactgcccactcctacatgatcacagaactgataacactccgcaagggagaaacatcagaaatctatcttacaaaaattcaactataaacagtcaggagggaaaaaagagagagatagatggtgacacaaatcatttaaataatgtggaatcctgtgcaccacttgactctgtgagtatataccctgtgatgaacatcttgctatgatttctctctccatctagcccagagtcatttttctggaatctgtgagtttggggatctatggagagagaattctgggggtcttcgaacttgtacatacccgctgatgaacttgtacatattcataattattttcactaactctaactgaaatttagcatgaccttcaattatgaatataggcaacagactgcagtagtattagcaacacccgagactttgacaccaacagaaattgcagatattttcatgtcacattgctttggtggcagatgtctccaaatattgtttatacttgtcattacttcaaaattagggtagttattagacctgatgccaaatctactttaatgtgttaataaagaagcaaatgtattattactccacagttttctgatttttatatatactttgacggctgtacttcaatataaccactttcctttttaatcctctgcatttttttgcatttgaaaatattcagagaaggggagcataattttgaccagattccgaagggatttacaacacagagaaggtgacactatcctgctgtagacagtgagctcactggtggcagggcaccaggtccttcatcttccaatccccagcacctaaagcagtggttagtatacaataggaatttttaaaaaatgaactgagatattttatctatctatccttttttccctccttccttcttccttccttccctccttccgtcttttctcccttccatctgtgtatccatcatcatccatccatcacctatccatccatccattcatccatcctccatccatcatctatccctccatcatacatccatccatgatgcatccatcaccccttgtccacccatccctctatccatccacccatccctctatccatccacccattcgtccacccatctattatccactcatttatctacccactcacctctctatccatctgcccacccatccacccacccatcctgtatccactcatccctctatccatccgcccatccctccatccaacatatatccatccatctgattcaatctacagttctaacagttgacacctctgcagttggtttcccagatccagttctgcagctcaactggagactccctaagaaggaaaagtgactcactgtggaaagaggtgatactatttccttgtatggccgtgggcatgtcacagaatgtgcctgcagctcagctgtctttcacaggctgaacacagagctctgtctccagctgccaccacatgggctggggccccaagctcaggcagagcgccatgcctgtgttcagatcatttccttacccaggaaca

SEQ ID NO: 1210 - DNA, 3834 bp, Homo sapiens
gcctgtgctatatttagcccctttagagaaggaagaaaatcgttttttaaagatgctacccaccccacagatgaacacttcccaccaccataaaggctgggggtggagacaggggcccagggaaggactggaaaatgcctagagggaggcctggcatccactcggcctcgctgcctgccagggagacacaggtgtgggccagagaagcaggtgaggaaaataaaacgggagagcaggagggggtgggcagcaatggtttgcagcctcaatccatccactcagcagagctcgtgtgctctcctggatggaggtttctggtacagcctgttttgggggcctctgcctggcacacggggccagggacacaagacagtgatagccaaggggatggcatgggcccgggcacagaaacctgtgtgctgcctatgctgggggcaggcctaccctgggtcctggtgagacccacaaaaagagccctctctgtgcaaatcgtcagcagagcactcaggaactggttccctgacacaccctcagcctctggaaggaaagaagcccagcattcatttcatggttgctcattcattcattcgtctttgagccaatgagccactatgcttgttgctgggaattcagcagcaaaatgatcctgatcctgaacccaatccagggtaatgttttgtgcatggaaggagcgggccagagtacagagcctggtggctacactgtccttcccaaagcaccgccacacactagagggaatgggctccttggaggttcagctggggtctgatgctggttttgcgcgccccaggagggggccctggctcagcccacctccatgcccaacacagtcacaaacaggaacactgtgtgcctctccctagtgtgaagcccaggattgcttctcaagatcttggctccattctctgttgcttaggcgtgggaccctgcctggtctccctttgatacctatccatcaccatgtcaagtgggagagacgtgaggggcttaagcatgccagcagcataaagcaaaagagcttctccacacaccctgctagctgcctctcctggctctcagctactctgaggacagtgtctgtaaagtcctagcaccttgccttgtccttggcaagtgctccattggtgctagccactgccctggtgacctcaaggtgggcaggaagctttcgtgggccgagatgggctacgccttgggtttgaatcttggctctgccacttactggccatgtggccttgggcaagttctgtgacctccgggttttgggggtggttaataacacagccctcttcctaagatgctgatagggtttggatgtttgtcccctccaaatctcatgttgaaatgggatccccagtgttggaggtggggcctagtgggaggtgtttaggtcatgggagaggatccctcacggacagcttggtgtcctctgggcagtaatgacttaccattagatctgcttgttaaaaaatgtctggtgcctccttgcaatctctctctctccccatgtgacggactagctccccttgccttccatcatcattggaagcttcctgaggcctcaccagaaacagatggtggcgccttgcttcctgtacagcctatagaactgtgaaccaaataaaactgttttcttcataaattacccagcctcaagtatttctttatagcaacacaaaacagactaatacagatgccctgaggactcaggagataatgcctgcatacgtcccagtctggctacggcaaatgctccacagatctccatagtggtgtctgtgctggtcttcctgacccagcagggtgctctgtggcatgaggactgtcttctggtcttcctgacctggcagggtgctccacggcagagggactgtttgctccctgccacttctgtgggaccaggcacgattggggcttacagtgagggcctcatagaggtttaatggactgaccagctgtacccctcccccttcccctctgggtgtccaaagggctggcaaggtcttaagaacaatcccgagatggctgaactttggatggtcctgcccttggaacaacaggtgtcattatcccctccccataatcccccctggctagaacccctgtacccacaaatcactgctttctcctccccaccctcaggaacagaatgccatgtctgcaggggaggacagcctcagggagactccacaggggatggaataggtgtgcactcatccacccatccactcacccatccatccatccgcccatctattcatctatccatccatccatccatgcatacatttcttccacagatgttcactgagttcctgtctgtcaggccctgggctgggcactgggcacagacaggttgagaagctccagcgccctcccgtgaggagctcacaatttcatggtgagggtgccgatggccaaactcatagaccctgaagaccattaagaggcaaaaaagaaggcttggctcttctctggagactaggccgtggttctggcccttgagtctttgagtccctatagcatatgaaggcacaagaacactcagcccccacacccagagcatcccaccctgctctcccggccccacctgcagagccacccggcctgcacatcacctcactgtgatttccggttgggaaagaggttgtggccaatcccccttctccccactgcccaccactggccactccctggcaggttccagccacagtggctctcacaaggctggctttacaactcactttctccaggagctagggccaagcccgagaatgcaccttaaccactgagagattccctttccaggggaagaagtagcccttgaggctgaagtggcagccatgttcgtgctcagcaggggtgaagttgggtcccgttatttgttcacttagcaaacaaggcacctggccctgtgcagtagacggaagagagcaagtgaggcacaatcctggccttttaaggactatagagagaggacttccaataggagatgcttaaggaagaagctggccttttagctgccctttaaggacagcccaggtgaggatttgcactgggtgtgtgtgtgagagcttgagagatggttttccaggcagagtgaacccctggacaacagcacgaaggtgggaatggcaccgatcatgatcgctgctaacactgatggtaggctcactgtgtgccagacaccattcttaacctccacccatattagctcatttaagcctcacgactgccctgcgcattaaatactctcatcctccctattttacagatgagaaaactgaggcgcagagaggcccaggtcctgccactggtgatggcagtgctgggtctgcacccatgcagtctgtctgcagagcccactcttcaccaccacactgttctgcctgtgagatgtgaaaagtgcagcatatgttgggggaacaatgaataattcagcttggcagaagcacagggtatgtgccatggagaccagcctggagaggaaggcgggggccttattgatgaggctccttgatgccagacgaggcagcttgcccttaaatctgggccatggggagccatggaaggtatttgagctgtggagttacaggagaggcaagacacagggagaagctcatgcctccagccaaaaaggtgtgtcagcagggccttctcgcccatcatttccctctgctcccatcccctgttccctggaaaaccttcccctttcctcccacactttacttctttccctttgggaagggtatagatacaggcagccctgcctcccctatctgctgtgtatcacctgggcagcccctctctgct

SEQ ID NO: 1211 - DNA, 2618 bp, Homo sapiens
gccctgcctacaacttattatacacagtgtttaaaacaaacaaaaaaatcctacacatccaaaaagataggaccacatatccaaaatcagagaaggaaaaaattcaatagaaacagtcacacagagaattggagttagatgaaaagaggactatctttagagagttggttcttataataaagaatcaaatgaaagttcaaaaattgaaaaatctaaaatctaaaattaagaagtccttatgcaggtttaacagcaaaatacagaatttctgaaatggaagacaagtaaatagaaaatatccaaactgaagcagagattttttttttaaagaaaaaaacataggagcattaggaatatgtgtgacatagtaaaaaaggtataacctatcagagtctgagaagttaaagaggagagtgcagggaaaaagcaatatttgaagaagtaatggctatgaatgtcatcaacccttaggattcaagaagctcttcaaatacctctttacaaaactgcaagtattgactatgcaaaacagtaacagtactattctgggaggtttaaaatgtatgcaaaatttaaaataatggaaataataatgcaaaaatgggaggcagtaaatagaattaaagtgttttataaagtatcctagcattattaaggagataaaatagtaagttcaagatgaatgttttaatatctggggtaacaaacagtaaaagaattataacaagtaaacaaaggaaaaaattaaagagtaaaaaaattatgtaatataaaaagtcaagaaaggaatgaaaaaataggtagttcaaataaaaactaggccgggcgtggtggctcacacctgtaatcccagcactttgggaggctgaggcaggcggatcatgaggtcaggagatcgagaccatcctggctaacacggtgaaacccggtctctactaaaaatataaaaaaattagctgggtgtggtggtgggcacctgtagtcccagctactcaggaggctgaggcaggagaatggtgtgaacccaggaggtggaggttgcagtgagccaagactgcaccactgcacaccagcctgggcaacagagcaagactccatctcaaaaataaaataaaataaaataaaaactaatagtaaggtggtatatataaattcaagtatatcagtaattacattaagtgtaaatgcattaaacatccaagttaaaagcaaggattgagacttctggttctaaaaaacaaaacaaaaaaaagagtgcattccacccaattcctcctgctaattacctaaaaatctagaaaaatacataaagcatctgtcagaagactcactggtggagaaaagaaagtagaacctaaggacttaaaaaacaacacagtagtgagttagttccctagagggaacttagagggagagagggagctcctacatattgcaaaatgagtactagaggagcttgcaacctggaagaaccaatgagcacagacaaaaaaggcctccccaaagcatacattttccagccaaataatttgaaatagggcagcaatgcaggatgggaccttttgactacacatacctacaaagttcagaagtacccaagaacaccctcacttctgacacctactgcaagcagagggatttcccaggatcacctgtacttctgacaccaattccaagtcaggggtccccaggaccaccctcaggttccacaattcacagaagaactcacagaaattagaaaagccataatactcatggctatggtgttatatagtggctttacaatgaaaggatacagatcaaaatcagccaagggaagatgtgcttagtgcagtgtcaatgagagttccaggtgtgagcttccagtggttttctcccagtggagtcatatggacagcacttacttctcccagcaatgatgtgtgatgataatacgcatggagtattgccaactggggaagttcacttgagccttgatgtccagagtttttactgagacttgatcatgtggacatgaatgactcccactgtggctgatcttagtctccagcccctccagagctgatattgcatggccaaaggtaccccactataaaccacatgttggcatagaatattcagtgtggcccaaagctcccaccataaatcacactgtcattatatactatcttgcatggcctaagcaaggcctgcaggacattccaaagatttagaggttacctcccaggagctgagtgcaaaggccaaacctctctttgggcaaagttaatcctttactgcacaacaatatacttgaggccaggcgcggtggctcacgcctgtaatcccagcactttgggaggccgaggcaggtggatcacgaggtcaggagatcgagaccatcctggctaacatggtgaaaccccatctctactaaaaaaatacaaaaaattagccgggcatggtggcgggcgcctgtagtcccagctacttgagaggctgaggcaggagaatggcgtgaacccgggaggcggagcttgcagtgagctgagatcacaccagtgcactccagcctgggcgacagagcgagactccatctcaaaaaaaaaaaaaaaacaacaaaacaaaacaaacaaaaa

SEQ ID NO: 1212 - DNA, 1876 bp, Homo sapiens
tgccataccacctttagtatacatagaatatgcctatatgacttatacctctaaggagataacttaacatctttgataaattcctcagggtagaaacactcatttattcacctttatggtcttcctaagacattgctcagaaccctgtgcttgatatgtactcaaaaaacaattttaggttgctgaatgaataacttcctgagcaagaacttctttgaagcaaagatttaagatactaagctggtggaaatggacattcaacattctgtgggatctactttagtgtgcctttgcacagtaatattcccgagtaaacaatttagaaaaatacaattttcttggaaaagattataaactattaagccataaaatttatgtctataaacaaaaacttatttaactattagaatccccttgaaaacaacacaatcatgaattttattaagctactataattaaaatattacataaaaattaacagcagcagaattattaaaatcctttgagttaacagaaggagctgaatttcttaatctaaggtaaaattctgcattgaaaatgattgccttgaaattaaaatcagtagtgttgtcagcatcagacctgggctcctaacactaaaatcagcaaagatttgtgatggagatttcacaagtgtaaatgctgatggaatgttatataaaatacttataaatattttattattattatttttttggactctgtcacccaggctggagtgcagtggcacgatcttggctcgcagcaacccccacctcccgggttcaagcctgcctcagattcctgagtagctgagactatgggcacgtgccaccatacctggctaatgtttttgttttttttagttttttttttgagacagagtctcactctgttgccaggctggagtgcagtggcgcgatcttggctcactgcaacctccacctcctgggctcaaacgattctcctgcctcagcctcctgagtagctgcaactacaggcacaccccaccacgcccagctaatatttatatttttagtaaagatggggtttcactatgttggccaggatggtctcgatctcttgaccttgtgattcgcctgccttggcctcccaaagtgctgggattacaggcgtgagccaccacgcccagcctttttttgtatttttagtagagaaggggtttcaccatgttggccaggctggcctcgaactcctgacctcaggtgatccacctgcccttggcctcccaaagtactgggattataggcgagagccaccgcactcagcctgaaatacttattaaatattttaaagcagcagtactaacaagcagtaagcaatgtaaactttttatcttatttaacatctatactgtattagtttagaaaattgttaagataattctttgtaaataaaaactgtcacaaaatatttgtacctaaggcaataccttacaaagagaaagtgcttaattagtaattattcagtaaattctagaaaattatgctagttagatgtaccatttcaatgtaattttatagcaaaattcttacataaaatactttaatatacaagattcaaattttcagcagaaaaattagtgtgttttcgtttgttagaacataattatgtcatgtaataattttgtaatctttttttataggtagtaagttttccttctaaatatataggtctaaagggccatgaaaacaaaagtccctttagtattgtattttaattttctgcaactgttcctcactgtaattctgaagaatcacttcccatatattgacaccaataagtttttaaaaatagccaaagatttctatattttatcccaattactcttttatagtacacatattatcatttt

SEQ ID NO: 1213 - DNA, 2744 bp, Homo sapiens
ctttcaaaataggtatttttcatgccataaatttgaatgaaattaacacaagtaattttatgctgctacagtttttattgttcattttccaacctgtattccaagtcttggggtcccctttaatttgccttattgacaaagctacttcccgctgcccacccttttctaaagtatgttcttccaaaaccatgtagcttctgattgctagcttaggtacaacctgactacagttcaggaggacgttgttttaattctatatgaaaaacactttctatttcaagagtgggagcctgtccatcattggtattagacaaatctttaaggacagaattgatttttgaaacctcttcaaattttgcttcaccttccaaaacaaccgatcctaattttactgctggaattcctgccacctgcggtgactgaaattctgtagacacattctctaccagagcctcatcttcaggggtttgttcagatggtggaggtgaaacttcagcagaggcctctcctataggaaactcctcagtcagaagcaaatcagctggtggggaatgtttgtcaacggaggcctcttctgcagggacatcatcagctgggggagagtgtactgcagcaagggtctcttctataggagtctcctcagctggtagagactgaacttcagcaggggcctcctcagctggtggaggctgaacttcagcgggggcctcctcagctggtggaggctgaacttcagcgggggcctcctcagctggtggaggctgaacttcagcgggggcctcctcagctggtggaggctgaacttcagcgggggcctcctcagctggtggaggctgaacttcagcgggggcctcctcagctggtggaggctgaacttcagcaggagcctcttctgcagaagcctctgtagctgctagaagctgaattgcagcagaggcctcttctgcagtggtctcttcacctgatggaggctgaagctcaagaggggcctcttctatagaaactcccttagctgatggagactgaacttcagcaggagcctcttctgcagaagtctcctcagatagtggagactgagcttcagcaggagtttcatctgcaggagcctctatagctgctagaagctgaatttcagcagaggcctcttctgcagtggtctcttcagctaatggagattgaacttcagcatgagcctcttctgcagaagtctcctcagatagtggagaccgagcttcggcaggagtttcatctgcaggaggctccgtagctgctagaagctgaatttcagcagaggcctcttctgcagtggtctctttaggtaatggagactgaaattcagtaggagcctcttctgcaggggtctccatagctgttgaaagctgaagttctcgagcctcttctctaggagcctcttcaggtaatagaggctgaacatcagcaagggtctcttcaacagtgggaggctctactttagctggggcctcttcaagggcgccctcagctggtaaaggctgtacttcaatgggagccttttgtgctgagggagaccgaatttcaccaagaagctctactgaaggagacttttcagctggtggaggcagaatttcagcaggaggctcttctgaaggggactcttcagctgatggaggcagaatttcagccagaagctctacagaaggagactcttcagctgatggaggctgaatttcagcaggaaactccactaaaggggcctcttcagcaggtggaggctgaactttaacagaattctccgcaactgcagtggctgcctcagcatcaggagtctcttcagttgatggctgtacttggacatgggtctcttcagcaggtctgggctccgctttagcagtggcctcttcaactaatggaggctgtattttagctgggaatttttctgttgatggaggctctatttcagcagaagccacttttttaacagcagaaccttcttgtacaacaggtacagttacttcttccctaagctcatcttctaaaagtaccgggggaccttttttagtctcctgagtaaatgaagttctgctgatatttttctgcccaatttcttcattgctgtttgttgctggttgaaattcagggtgttcactagcaaaaatctttcccgacgatttatgtttcagggcatcttcctttgactttgtagaagaactatctggcctggaaataaccactatttctgattcactaaagtatgtctgttgttccttgtccactttttctacaggggggatgttcatcatggtccagtatcctgtacggctggtctgctgagatctgtccatttttagttgaactgaaggtatgtttggtggaatttctacatcctgaacactctctggcaattcaatagcagcttctctaacatcagctgacttttcttcaggtaccacggtttcctcaactaacttgacttcttttttctcttctacaatggtgtctgtctggagagacttactagtcatttcctgtccatgctttctctttgtccaagtttgctgaagctcagaagatactctaatagactcataggctttggcagagtagctgcctttgcttccagaagtattaccaatacgatgggtagctttggggctagatgattttggtatggccatgtgtttctttttctctattacatcagtttgctgggatttgcctaccattggtttgctgggtcatcttctctttcgaatttcttgcctaca

SEQ ID NO: 1214 - DNA, 18 bp, Homo sapiens
aaactcatatccagtggc

SEQ ID NO: 1215 - DNA, 72835 bp, Homo sapiens
agaggccgtttgctcagggaaagtaaaaccaatgacctgactcaacgcggacacgtctgccccgccccctaaaacctgcttctggggccgctgtgtggtctggagcgccgcctggtggtcttgtgcttccctgcagggaggtttgtgtctgggctcacgctgaggtccccattctgtctcccacgggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttctgaaatctctgagacactcacatggaggtacagccatcaggcagaggacgacacacagagatctcatgttttcctcaacaaggggctcgactttctcagtggcctctccaggacagaacaagaaaaaataactggctgtctctagcctgaggttgcatttcgctgggtctctgggatggaaatgtgtcttgtgtcttcaggagtctgcagggcagccgctgctgtgactcaggtagaaacttctctcccctgatgtcctggcccctcgttatccctgccacagtgcaatcagactgggcaccgctttagggagaaacggaggacatggagtgagggcagggtagtggagactattgaagagagtcaaaactctccaggggtagagacgcctccaggaccccttggcattgttttcttcactttgcaggagtaggaaggagctgagagtctagacagagcctcagatgcacaaccctgatttggcatatcggggagcaatctcatcagcccaggagaaggcccaggagaaggggcagctctttgtgcctctgcagagaagcggcagggactgggaggacattttccctgcccagcaggtggtgctgcctccttgttccctgcctggcacagcctcggggtgcagctgctggctttcccagggtctgtggagagcgtcttcttggtacttccttaacgtcaaataaagtgaatgccttctcaatgcacatcttaattcatcattggaaaggccaagacacacgcacacacacatctatatgtttttctgacaagagctagagacaattgataagtatgttatctgactgtagttcaccttaaggaggaaaaaactattaagaaatttcttaagtgtaaattgtgcctaattatgagtaaattagtaacagaagtaaaaaataataactgcagtcaacttatacactttaaaagaatactctgtgaaacaatgacgtgttatcaaaaaagggacacttaatttgttatgtgtggtgatggtcaatgagcagactcgtgttcttgctggagaagtcgcagcatccccacaggtggacttcctgcagcaatcttgtgtgtctcacacttctgtccaaagcatgtaaggggggaactcagtgcgcacaggaacctgacgcctgccatccaagggatgcgtgagcttccgtataagcagaagaagatggaaacttcagcacctgcaacagaagaggctttctgctttggggacccaaacagttccatctatggtggagatgtaggctcattcctacatcaacgtcaacaagccattggacacaacaacatttaggagtagtcgaccgcaccttctccaatgtggcctgcacagcccaggctgcagggtgggagaggtcgattctggagaaaagtcattcctgctcccctggtacactctcctcccccactgcttcatacagggaccaatgtgatgatgccatcatgatgttgaagcacacactgagccctgtaatcaattagagggctttcctatccacccatccacacacacatccacccatccactcacccgtccatccgtccaccacttatccatgcatccatccacccacccagccatgcattcatccagccatcccacaatccacccacccacccacacatccaaacgtccatccacgaattcatgcatctgtccacccatccagccatgcattcatccagccatcccacaatccacccacccacccacacatccaaacgtccatccacgaattcatgcatctgtccacccatccagccatgcattcatccagccatcccacaatccacccacccacccacacatccaaacgtccatccacgaattcatgcatctgtccacccatccagccatgcattcatccagccatcccacaatccacccacccactcacacatccaaacatccatccactaattcatgcatctgtccacccatccagccatgcattcatccagccatcccacaatccacccacccacccacacatccaaacgtccatccactaattcatgcatctgtccacccatccagctatctgttagcaggagcgaatccatacaggtctgcagcaacttgattctcgcctccttggaggaaagaatttggccaaggggcatacagaagagtgagagacccaagcaagttttagagcaggagtaaatgtttattaaagttttaaagtgggaactaaaggaagtaaagtacacttggaagagggctaagtgggcgacttgagagatctaagtgctctgtccggcccttgacttggggttttatacattgacatggttctgggatttgtatttcttctcccttgattcttcccttggagtgggctgcccacatgtacagtggcctgccagcacttgggaggggctgcatacacagtgggtttaatgaaatgtgcacatgctcatttgaggtgtccttctcttactattagagtgttcctagaggaagattatgtgccagttaaactctgccactttgcctcttagtgcatatgcttgagcccactcacccaatgcctgagatcttatcaggaagctgctgatgaccagtttcgggtgttttctatctattgggagactgccttttcttggcgctggctgagatcaattattatttattattattattattatttgagacagagctttgctctgtcaccaggctggagtgcagtggcacaatctcagctcactgcagcctcttcctcccaggttcaagcaattctcctgcctcagcctcccgagtagctggaactatagatgcacgccaccacgcccagctaatttttgtatttttagtaaagacagggtttcaccatgttggtcaggatggtctcaatctcttgaccttgtgatccgcccacctcagcctcccaaagtgttgggattacagacatgagccaccgcgtccagccgagaccaattattattttagagaggcagtttaacaatcacttgactatcagctcatgcctgcctaactacccactctaatacatccatcccttcacatacccattcatccatccatccatccatccactcacttatctatccaagtactcatccatgcatgtagccacccacctacccacccattcatccactcacccatccatccacccatccatgcatccatcaacctacccatccacccatacatgcatccatctatcttttcactcttccatccacacacctactcagccatccatccatccatctatccatccatccatccatccatccatccatccatccatccatccatccactaatccatggttgggtccatctgtctgtgccacaaacatgcaaagataagttccatgtgacaagtctgaactcagtgttggaatcatgggaggggcaaggtggaacaggctggcttcctcaccactgttaacactgtggggagaaggccgatggcaaactcacttccatgttaaatttcctaaaagaggaaggggagtgtcatgctagagagtaatggaagctcccactgttgacacagaggtaataaatgcctgtctgatgagctaagacctgcaggaacagaaacagtcagccacatgaaaacaaggcaggaaagaggcctatggcagaagagcagctgctgaaagttcccttaggttgggcaaagctgttacgttttgaggaactaagaacagtccaagggcaagccaccgccctgtgtttctcctcttcccctgtgtctgtctgtgttccacagtgattgtgcaaactctaaatacatcgatgacccaccactgcctttatgttagaataaacaaaacagaaaacaaatatctgatgaccccacaggttgccctctttcactttgtatctctcatttctgtgcctctctctctctctctctctctctctctgtctcccttcatctggctcatctctctgtatatctttttgtcttattatttcaacaagggctcttagggtccatctaccgtgctggaaactttcttctcaccaaccattgtaagttggagaatgttttctccaccttattacaaaatgttatagctaattctcttactgcagaataatctttaatatgggtgccctgtttttagaatttaaaattagtatcaattgccattttttcacaattacaattagtattttacaaatgagttttgtaacagggcagggcattaatgaattaaattactctgtaataggaatgagaaattttattttaatatttttgagacagagtcttgctttgtctgtcaggctggagtgcggtggtatgatcttagctcactgcaacctacacctcttgggttcaaacgattatcctgcctcagccccccaagtagctcagactacaggtgcatgccaccatgcccagctaatttttgtatttttggtagatacagcgtttcaccatgttggccaggctggttttgaacttctgacctcaggtgagccacctgcctcggccttccaaagtgctgggatacaggcatgagccactgtgcccagccaagaaattttatttttaatggaccctcttagatagttcttaataatggcagtatcaaaatacatgcaattatgcatatggaagtagcttttttcctacaaacttaagaatatttcaaatcatcttctctctattcttttgaattacatgtgtgagaaacagattataagtatttcatgttattttcccagacatcactataagcatcaagtaactattcacatgtgtgccagcgatttatcatcatactcatgagggttttctatttctagaagttgcccattttttgatctctttttgctttttccttcttgtaaatattggagttcttaattcttttctaatgctgtagatcctcctagggaaggattctctacagtactacatgtgttagaatgtgggtgaaaaattatacgtgctttaaataatgaatgagccccgaaaaaaagagctggaagttgccaggtgctaggaatagacaaaattaaaaagggcatttgaattgagaatgaaacctgaatgcccccttgcatttctgaggtaggtttaacatacacaggacgggagcagccttgtgtgacttgtgggactggagctgaggtttcggcttgagtagagaggttttttttttttttttaaataattagtttctcttttgattgacacataaaaatgacctatatttattctgtacagcataatgttttgtaacatgtctacataggggagtggctccactgagctaattaacatctgtatcactcacctactccccatacggctagagaggttctaagttggcttcagccatgatgtcaggttagaaacattccctcatgaacagcagccctggacatggtagaaaagcaaaccccaagccctcgctgttcacaaagtggtcctagtgtctcacccaccatctggagctgcaaaactgagctgggaaatcactgtcgtggagtgccactggcagcacacaggtcccagcagccaggagcaaggcaccatccacagatgcctgctcccgggggaccacagctcctgtgatgaggtctcatacatagaaaccatgtgatgagcaagggaaaagcgtgtcatgacattctgaaggccacaaagagggaggtaaacctgtagagatgacagatacttcaagttactttctgatttttctaaaattataaaatagatcaacaaaaagctagagaagaatgaataattcaagaacagattttaagaaagaagaactttctgatgtgtgaaagtacccaatatgcattatcataattgtaggcattgagctctcaatgaaagaatgacctcacacttgacactcagaaggggataaataatgttggatagattgccaaagtgttctagaaagaaaataatccatctttaattttacaataccactctttctacaatgatagcgaaaaaaaaatccagatacaaatggcaggaaagtggagcatatagtttcctgctgaagctgctgttgatgaacgtgcctcacttgcatgatctcggctgtgcatagtgtgtggccagtggggagcagtgcttgtgggtggctgaataatgcatcccccaaatgtttacattcaaacccccagaacatgtggtttagtgacctcatatggcacgaggaactttgtagatgtgattaaattaatctcgagaggggagaatatggccctgcattgtctgggtgggtatgatgtaatcacaagggtgcttataagtggaagcaggagaaccagagtcaggggaagggtgatgtgatgatggacacagagatgagaggatggcctttgaagatggaagaaggggacacagagcaaggaatatgggttctagaatctggaaaaggcatgaaaacagaatctccctcccagggttcagaagaaaccagctctgccaacgctttgcctctggactaataaaaccgcaggaccaccaagaaactgctctttcttgcatagaacacagtcagtatgctcacacgacatgggtgggtttgagagttaaaggagactgcaaggtctctggctgaaacagggcaggaatcaggtggagcaagagggtgggtaggcaggacctgattttcaggagtgtaaatgtgaggcactgatgagatttccaggtggagacagagggaggagtcatgtgttcaggtctagagtggagctggtaggttggtctgagcctgagaaaggagggcatcctccaggaattgagagtaggaaaagggaagagtggataagtgctaagaactaagtgggagatttctggaggtggcggctcacagagccagcaatgtcttatggttggggtttgtaaccccagtcactgaaagtgtcctcccagcctctctctgcatatgcccctggggctgagtgcctgcgttggatggtcacttaccattccctaagaggccctaatcacctcctgcagcccagctcctcctggaccctctctctgcatatgcccctggggctgagtgcctgcgttgggtggtcacttaccattccctaagaggccctaagcacctcctgcagcccagctcctcctggaccctctctctgcatatgcccctggggctgagtgcctgcgttgggtggtcacttaccattccctaagaggccctaagcacctcctgcagcccagcccctcctggaccctctggaggggaagtttgtgtttgtgtttggtcacggagcccggctgcagagaaaacaagttttttttttttttttttctaaaggatctcactctgccacccacgctggagtgaggtggtgccatcatagctcactgcaacctcaacctcctggcctcaagccacactcccaccttggcctcccaaagtgttgcgtttacaggtgtgtgccaaggtgcccactcaaaaacgggttcttggctgggcactgtggctcaagcctgtaatcccagcaccttgggggtcaaggtgggtggatcacttgagcccaggagtttgagaccagcctgggcaacagactgtgacatgaccatttagcttatgcaaatgtgggactggttaaacggtctatgtggggctgtcgccttgtctttgcatctgtcactgaggccagaagtcagcagggcagacagttgggaaggaaagacagtgggcaagctgaggtggacagaggcagccacagggatggactgggacacatgaaggcaggcgaaaccatgttgtctctcacaccctttcaagggtctagagggagtcctttaactgattttcttccaatatatgtaattatcaggctggaggtggtgatactggagttcatagcctgactggaagctgtaaaaagcttgtacaaccttatggtgattaatttttatagccttaataagccccagaaataagactaaggcagagacttgatttaggattttgatttttgagaacatttgttatagatgctaaaaggctcaaaatatttgatcaaaacagaatcacaggccattgtaaaatgatagttactaatttaaccgaagtggtaattaaaaagactttggaggcgagtcaagatggctgactagatgcagccaggaggaatatctgccatggagggagtgagacatcaggaagacgggtgctttccaagcagatctttgaaggggaggcattgagagtggattgagagtagacgggggaggacacagatgctgagctgaaggtggaggaagatgggaaccctgcatggggatgccaagcaccaggactcattcctggctcccagcaactcctggggaaaggttgagttgaacaggtgaggagtggcctgctgttgccatgggcctccagaatcctagcagcaggagaccccatgacccccatggacacttgtgctggaagggacagctgcttagagagatgccaggggcaggactccagtctgtgtaaagcccagagtgtttgacatgagaatggctgtagtggagcacagccaggggacacccatcccccaaggctcaccaacctcctctaggagattttaaccttagagtgactatgggacctgaataaagcagggtggtcttgtccatgggacagggcccatctgaaatgagaatttccttgccttctggcctctcctggggccccaggctggctgtgcctgcttgcagtacagccttggaagcccaaccagggtgtttcctgggggccctcatcatagctcctttgccagcagaccatgcctaaccattggagacctccagcaggccagcctctgctgatgtgcaccagtccacccatagtacctcccaactgctttgctggcatgagtgcacagcagatcacaactccctctaccaccagcaagcatgtgcatgtgtgccccaccaccctgtccctgccaacacacgggcacctcactgcgctgtgactgccagcaggaacctatgtagggatgctgccactctgctcctgccagtacccccaccccagcagatgcatgtgcaccctgccatgactccacaactgctggcacccatgagtaagaatggatcccactgccaccactctaatgaagtgctttggccggcaccccctactatagtgttgtggccaatggactgggaacacctcagcccctccaatgcagcaagtttctaaactcaaggggccagagaataaagccaggggcccagtcccagagcagagaacacaccacaagagtgctgaggtgagcctggaccctctaagattttcaagaaacacagctaactgaatccactttataccacaatcaaacctgcaagagtatcaaagaagataagagcaaaaaacaaacaaatgaacaaacaaacaaaaacacacaccaaaaaacaacaaaaaagacaaaaacatccaaaggacagccacttcaaagattaaagaaacagcccacaaagatgagaaagaattaatgcaagaaactctgcaactctaaaatccagagtgtcttcttacctccaaataatcacactggtttcccagcaatggttcttaacctgactgaaatggctgaaatgacagacatagaattcagaatatgcacaggaaagaagatcactgagattcaggagaatgttgaaacccaatccaagggagctaagaaataaagtaaaatgatacagaagctgaaagatgaaatggccattttaagaaagaaccaaactgatttgatagagctaaaaaactcacttcaagaatttcagaatacaattacaagtattaacagcagaatagaccaagctgaggaaagaatcacagagcttaaaaactgattctctgaattaactcagtcagacaaaaataaagaacaaagaataaaaaagaaggcataaaacctcagagaaatgtgcaattatgtaaaaagaccagatctatgacacattggtatcccttaagaagagaaagagaaaaaaagaaacttgaaaaacatttcaggctatcctccatgaaaatttctccaacctcaccagagaggccaacattcaaattcaagaaatgcaaataacctctgcatgatattatacatgacaaccatccctaagacatatagccatcagacatcagactcttaaaggttgaaaggaaaaaaaatattagaggcagctagaaagaaggttcaggtcacatacaaagggaacccaatgaggctaacaatggaggtttcagcagaaactgtacaatccagaagagattgggggcctatattcagcattcttaaagaaaagaaattccaagcaagaatttcatatctagccaaatgaagcttcacaagtgaaggagaaataagatccttttcagacaagcaaatgctaagggtattcatcaccactagattgccttacaagaggcccttaagggattgctaaatatgataatggaagaacgttactggccaccacaaaaacacacttaagtacataacgattgccactataaatcaactatacaatcaaatctgcatattgagcagctaacaacatgataacaggatgaaatatgcacatatcaatattaaccttgaatgtaaatgggctaaatgccccaattaaagggcagagaattgccaagttggagaaagaagcaagacccaaatgtatgctgtcttcaagagacccatctcacatgcaatgacatccccaggctcaaagtaaaaggatggagaaaaatctactaagcaaatggaaaacagaaaaaagcaggtgtttctttttttaaaaatttttttattatactttaagttttagggtacatgtgcacaacgtgcaggtttgttacatatgtatatatgtgccatgttggtgtgctgcacccataaactcatcaattaacattaggtatatctcctaatgctatccctccccactccccccaccccacaacaggccctggtgtgtgatgttccccttcctgtgtccaagtgttctcattgttcaattcccacctatgaatgagaacatgcagtgtttgtctttttgtccttgtgatagtttgctgagaatgatggtttccagcttcatccatgtccctacaaaggacatgaactcatccttttttatggctgcagagtattccatggtgtatatgtgccacattttcttaatccagtctatcattgttggacatatgggttggttccaagtctttgctattgtgaatagtgccgcaataaacatacgtgtgcatgtgtctttatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccgttctaactggtgtgagatggtatctcattgtggttttgatttgcatttctctgatggctagtgatgatgagcattttttcatgtgtcttttggctccataaatgtcttcttttgagaagtgtctattcatatcctttgcccactttttgatggggttgtttgtttttcttgtaaatttgtttgagttcattgtagattctggatattagccctttgtcagataagtagattgcaaaaattttctcccattctgtaggttgcctgtttactctgatggtagtttcttttgctgtgcagaagctctttagtttaattagatcccatttgtcaattttggcttttgttgtcattgcttttggtgttttagacatgaagtccttgcccatgcctatgtcctgaatggtattgcctaggttttcttctagggtttttatggttttaggtctaacatttaagtctttaatcctcttgaattaatttttgtataatgtgtaaggaagggatccagtttcagctttctacatatggctagccagttttcccagcaccatttattaaatagggaatcgttttcccatttcttgtttttgtcaggtttgccaaaaatcagatagttgtagatatgcggcattatttctgagggctctgttctgttccattggtctgtatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagcagtttttcccaattctgtgaagaaagtcattggtagcttgatggggatgtcattgaatctataaattaccttgggcagtatggccattttcaggatattgatccttcctacccatgagcatggaatgtttttccatttgtttgtatcctcttttatttcattgagcagtggtttgtagttctccttgaagaggtccttcacgtcccttgtaagttggattccaaggtattttattctctttgaagcaattgtgaatgggagttcactcatgatttggctctctgtttgtctgttattgggttatagaaatgcgtgtgatttttgcacattgattttgtatcttgagactttgctgaagttgcttatcagcttaaggagattttgggctgagacgatggggttttctagatatacaatcatgtcatctgcaaacagcgacaatttgacttcctcttttcctaattgaataccctttatttccttctcctgcctgattgccctggccagaacttccaacactatgttgaataggagtggtgagagagggtgtctctgtcttgtgccagctttcaaagggaatgcttgtagtttttgcccattcagtatgatattggctgtgggtttgtcatagatagctcttattattttgagatacgtcccatcaatatctaatttattgagagtttttagcatgaagtgttgttgaattttgtcaaaggccttttctgcatctattgagataatcatgtgttttttgtcgttggttctgtttatatgctggattacgtttattgatttgcgtatgttgaaccagacttgcatcccagggatgaagcccacttgatcatggtggataagctttttgatgtgctgctggattcggtttgccagtattttattgaggatttttgcattgatgttcatcagggttattggcctaaaattctctttttttttgttgtgtctctgccaggctttggtattaggatgatgctggcctcataaaatgagttagggaggattccctctttttctatagattggaatagtttcagaaggaatggtaccagctcctccttgtagctctggtagaattcggctgtgaatccatctgttcctggactttttttggttgttaagctattaattattgcctcaatttcagagcctgttattggtctattcagagattcaacttcttcctggtttagtcttgggatggtgtatgtgtcgagaaatttatccatttcttctagattttctagtttatttccgtagaggtgtttatagtattctctgatggtagtttgtatttctgtgggatcggtggtgatatcccctttatcattttttattgcatctatttgattcttctctcttttcttctttattagtcttgctagtggtctatcaattttgttgatcttttcaaaaaaccagctcctggattcattgattttttgaagggtttttttgtgtctctgtttccttcagttctgctctgatcttagttatgtcttgccttctgctggcttttgaatgtgtttgcacttgcttctctagctcttttaattgtgatgttagggtgtcaattttagatttttcctgctttctcttgtgggcatttagtgctataaatttccctctacactctgctttgaatgtgtcccagagattctggtatgttgtgtctttgttctcactggtttcaaagaacatctttatttctgccttcgtttcattatgtacccagtagtcattcaggagcaggttgttcagtttccatgtagttgagtggttttgagtgagtttcttaatcctgagttctagtttgattgcactgtgctctgagagacagtttgttataatttctgttcttttacatttgctgaggagtgctttacttccatctatgtggtcaattttggaataggtgtggtgtggtgctgaaaagaatgtatattctgttgatttggggtggagagttctgtagatgtctattaggtctgcttggtgcagagccgagttcagttgctggatatccttattaactttctgtctcgttgatctgtctaatgttgacagtggggtgttaaagtctcccattattattgtgtgggaatctaagtctctttgtaggtctccaaggacttgctttatgaatctgggtgctcctgtattggatgcatatatatttaggatagttagctcttcttgttgaattgatccctttaccattatgtaatggtcttcttcgtctcttttgatctttgttggtttaaagtctcttttatcagagactaggattgcaactcctgcctttttttgttttccagttgcttggtagatcttcctccatgcctttattttgagcctatgtgtgtctctgcatgtgagatgggtctcctgaatacagcacactgatgggtcttgactctttatccaatttgccagtctgtgtcttttaattggagcatttagcccatttacattaaaggttaatattgttatgtgtgaatttgatcctgtcattatgatgttagctggttatttggctcgttagttgatgcagtttcttcctcgctttggtggtctttatgatttggcatgtttttgcagtggctggtaccagttgttcctttccatgtttagtgcttccttcaggagctcctgtagggcaggcctggtgatgacaaaatctatcagcatttgtttgtctgtaaaggattttatttctccttcacttatgaagcttagtttggatggatatgaaattctgggttgaaatttcttttctttaagaatgttgaatattggcccccactctcttctggcttgtagagtttctgctgagagatcagctgttagtctgatgggcttccctttgagggtaacccgacctttctctctggctgcccttaatattttttccttcatttcaactttggtgaatctaacaattatgtgtcttggagttgctcttctcgaggagtatctttgtggggttctctgtatttcctgaatttgaatgttggcctgtcttgctaggttggggaagttctgctggataatatactgcagggtgttttccaacttggttccattctccctgtcactttcaggtgcaccaatcagacatagatttggtcttttcacatagtctgatatttcttggagggtttgtttctttctttttacttttttttcctctaaacttctcttctcccttcatttctttcatttgatcttcaatcactgataccctttcttccagttgatcgaatcggctactgaagcttgtgcattcatcacgtagttctcataccatggttttcagctccatcaggtcatttaaggacttctctacactgattattctagttagctactcatctgatcttttttcaaggtttttagcttctttgcaatgggttccaacttcctcctttagctcggagaagtttgatcatctgaaaccttctctcaactcatcaaagtcattctccatccagctttgttccattgctggcgaggagctgcattcctttggagggggagaggcactttgatttttagaattttcagcttttctgccctgttttttccccatctttgtggttttatctaccttttgtctttgataatggtgatgtacagatggggttttcatgtggatgtcctttctgtttgttagttttccttctgacagtcaggaccctcagctgcaggtctgttggagtttgctggaggtctactgcagaccctattttcctgggtatcagcagcagaggctgcagaacagcgaatattgctgaacagcaaatgttgctgcctgataattcctctggaagcttcatctcagaggggcacccagccgtgtaaggtgtcagtctgcccctactggagggtgcctcccagttaggctactcgggggtcagggacccacttgaggaggcagtctgtccattctcagatctcaaagtccatgtgggagaaacactactctcttcaaagctgtcagacagggacatttaagtctgcagaggtttctgctgccttttgttcagctatgccctgcccccagaggtggagtctacagaggcagacaggtctccttgagctgcagtggactccacccagtttgagcttcccagccactttgtttacttactcaagcctcagcaattgtgggcacccctcccccagcctcactgccaccttgcagtttgatctcagactgctgtgctagcaataagcgaggttccgtgggcatgggaacctccaagccaggcataggatataatctcctggtgtgccatttgctaagaccgttggaaaagtgcagtattagggtgggagtgaccggattttccaggtgccgtccatcaccgcttcccttggctaggaacgggaattccctgaccccttgcacttcctgggttaggcaatgcctcgccctgcttcagctcactcttggtgggctgcacccactgtcctgcccccactgtccaacaagcccccgtgagatgaacccagtacctcagttggaaatgcagaaatcacctgtcttctgtgtagctcatgctgggagctgtagactggagctgttcctattcagccattttggaactgccccctcatagattcttgatattagacctttgtcacatgctgatgtggtttggctctgtgtcattaaacaaatctcatctcaaatagtaatccttatgtgtcaaggggtggacctggtgggaggtgactgggtcataggggtggtttcccccatgctgtcctcatgttctcctgatagtgagtgagttctcatgagatctgatggttttatccatgtatggtggttcctccttcattccctctctctctctttctctctctcacctgctgccatgtgtcacatgcctgcttccacttccaccatgattgcaagtttcctgagcctccgaccctaaccacacagcactgtgagtcaattaaacctcttttctttacaaattaaccactttcgggcagttctttatagcactgtggaaacagactaatatagtaaattggtaccaggagtggggaactgctataaagataactcaaaatctggaagcaactttggaactgggtacctcctggcagcggttggaacagtttggagaacttgaaaggagaagggaagatgtgggaaagtttggaacttcctagagacttattgagtggttttgactaaaatgctgatagtgacatgaacagtgaagtccaagctgagctggtcttaggtagtgaggactaaactctgatttttttttcatcttgcccaaattcctatctaaagagtctggggaggcatgctctacaaatcataaattctcatcagatgggttttatttaaacctatatatcatgatttactttccaaactgactctggcataacattatgagacaaataagaaaatcaaaatattttaccccaaaacatgtttctttgccatactctgagatggccctgcaggccgggcatggtggctcatgcctgtaatcccagcactttgggaggctgaggtgggcggatcacctgaggttgggagttcgagaccagcctcaccaacatggagaaaccctgtgtctactaaaaatacagaattagccgggtgtggtggtgcatgcctgtaatcatagctactcgggagactgaggcaggagaattacttgaacccaggaggtggaggttgtggtgagacaagatcgtgccattatactctagcctgggcaacaagagcaaaactccatctaaaaaagaaagaaagaaagaaagaaagaaagaaagaaagaaagaaagaaagaaagaaagaaagaaagggccctgcaaagctgttctttgtgggggaaaatttgcatctgtaaagaatctctattaacatagctagatctttttcttctagaacctcccaatcctaaagagttcaactaagatttgaataggaaacatttgtcacctattatctctaagggcagccactataagacttcaaaagaactttggactctacaatctttatcttaacctgaacattacctttctatctatcccaggtctttagacaaactcaaccaattgtcaaccagaaaatatttaaattcacctatagcctggaagccctagctttgagttgttccacctttctggaccaaaccaatgtgtctcttaaatgtatttgattgatgtctcatgcctctctaaaatgtataaaaccaagcttgatggaattttgtccctgccctagaaatctgtggaactttgcccttgagagagatgatctgaaataggaacttatttttaaaagggaaacagagcataaaagtttggaaaatttgcagcctggccatgtggtagtaaagaaaaacacatttgctagggagaaattcaagttggctgcagaaatttgcataagtaatgaagagatgaatattaataatcaagacaatggggaaaatgtttccagggcatgtcggagatctttgcagcagcccttccaatcacaggcctggaggcctatcagggaaaaatgttttcatgggctgggtccagggcccagcttctctttggagccttgggacttggtgccctgtgtcccagctgctccaggtctagctgtggctaaaaaagtccaatgtacagctcaggccattgcttcagaaagccccaatcattggtggcttctacatgatgttgggcctagggatgtgcggaagagaagagttcagctttgtgatcctccacccagatctcagaggatttatagaaatgactggatgtccagccagaagtctgcgccaggggcaaagccttcatggagagcctctgctagggcagtgcagaagggaaatgtggggttggagcccccacacagagtccccactggagacagtgactaatggggctgtgagaagagggccaccatctttcagaccccagaatggtagatccattaacggcttgcactgtgcacctggaaaagctgcatgcactcaatgagagcagccaggagggctgaactctgcaaagcccatgagagcagccatggggtcagagctgcaaagccacagggtgagagcttcccaaggttgtaggagcccccactttgcataagcatgccctgaatgtgaggaatggagtcaaaggagattattttgaagctttaagatttaatgactgccccactggagtttgggcttgcatgtgacctgaagcccctttattctggctcatttctcccaactgaaatgggagcatgtatctaatgcctgtacccccattttgtcttggaagtaactgacttgtttttcattttacaggttcatagatgaaagggacttgccttgtctccaatgtgactttggatttggacttttgagttaatactgaaatgagttaagatgttgggggactgttgggaaggcatgattggttttgaaatgcaaagaggacatgagatttgggaggggttgggtggcgtgatctggtttggctctgggtctctacccaaatgacaccattcctcagggtgatcagtgagctacctgatggcaggttggattatattggacctcttccatcctggaaagggcagaggtttgtcctcactgaaatagacacttactgcagatatgcatgcaatgcttctgccaagactaccatctgtggagtcatggaatgccttatccactgtcacagtattccacatagcattgcctctgaccaaggcactccctttacggctaaagaagtgtggcagtgggctcatgctcatgggattcacttgtcttaccattttccccatcatcctgaagcagctggattgatagaagaatggaatggcctttcaaagtcacaattacaatgtcaactaggctccaatactttgcagggctggggcaaagctctccaaaaggccatgtatgctccaaatcagcatccaatatatggtactctttctcccatagccataattcatggatccaggaatcaaggggtggaagtggaaatggcaccattcaccatcacccctagtgatccactagcaaaatttttgcttcctggtcccatgacattacattctgttggcctagaggtcttagttccagtgggaataatgctgccatcaggagaaacaacaacaattccattaaactggaagtaaagatttccacctggccactttgggcccctcctacctttaagtccacaggctaagaggggagttacagtgttggctgggctgattgacctggactatcaagatgcaatcagtctattactccacaatggaggtaaggaagaatatgtatggaatacaggagatccattagggcgtctcttaacattaccatgccctgtcattaaggtcaacgggaaactacaacagcccaatccaggcaggactacaaatggcccagacccttcaggaatgaaggtttgcatcactccactaggagaaaaaactctacctgctgtgatgcttgctgaaggcaaagggaatacagaatgggtagtagaagaaggtagtcatcaataccagctacaaccacgtgatcagttgcagaaatgaggactgtaattgtcatcagtatttccttcttcttttgttaaaaacatgtttgtgcatgtacacacttgtactaagaaaattccttcatttcttttttcctttatcatgtgacataaaatttattgacttcatatcagcatttaagtgttcttaactttacataatagcatttgggttggggattggtgcatttctggttgtacaaaagatagttgtattacattaggtgtaattatgaccttattattgtctttatttgaagattatgtatgatctcaggagatttgtatgggttcaagttgacaaggggtggacttgtgatggttgatactgagtgtcaacttgattggattgaagcatgcaaagtattgatcctgggtgtgtctgtgagggtgttgccaaaggagattaacatttgagccagtaaactgggaaaggcagacccacccttaatctaggtgggcaccatctaatcagctgccagtgtggccaggatataaagcaggcagaaaaacgtgaaaagactagactggcttagcctcccagcctacatctttctcctgtgctggatgcttcctgccgtcgaacatcagacttcaaattcttcagctttgggactcggactggcttccttgctcctcagcttgcagatggcctactgtgggaccttgtgattgtgagtttaatactcctcaataaactctaatatatatataatatatataatatataatacgtattatatataatatataatacgtattatatattgtatatatacatattaggtttctctagagggacagaactatatatatatatagtttccatagtctgtggtgtagactaggtgaaatggagtttacagcctcctgaagggtaacacccagactctcacctgaattccctgaaatcctgtgccctggggattggagaaaccttaaaaccaaagccactgttaagttagctcagtctttgattgagcatggccatctgcctatacttggcttccagggctgggtgaaggagaattcctgcctggaacaagctcacattacaaagaatcttcacagtgctcatgagacatctcagaccttccatcagaagcattcaggatggcaggagactggacatgatgagcaatatggggataggaggaaggaaacagagaacggaaggaggtgacagctgacaaggccttgtgttctcagatgctgagcatgaaatgaagcatttatgatgagggaaacagaacagatgtacggtacaatattaaatataaagcagtaaattacagcaggtggcttcacagcagcttagacatagcagaagagaagaggatggaattggaagatcgatgctcaggacggatgcagagtgaagccgaggatccgacaaagaggatttgggagatgcaggctttgggagagaaggagggggattggaagaagaaagaatgtttgaaagtactccatagagaaccaggacagcccctggggccaagcagcccatgacccttgcagcttcagaggtccagactccagcctggcctcacatgctggttggtcttatccctgccaggccagaaccctcttcagaacccacttcagaacccagagcccccacagctctccctcaccctatgcccgggacatgtctcccgtgcactcttccctgccccacaggtgggagtttacacctgcttgggtggcctcggcatccacaccaacaacctgttagcagttgtcctgctccctccacctggcacagtgtgaatctcccacagtgcaggccccgtgtttgggagtgattaggacacacaggagggcaggtcaggacaacaggtgctgaggcaggcagatttccaggatttaagtgccgatgctcttggaagaccatttccatggggttaatggtggtttttcttggtgaactgttggcttgtgtttttgatattgctgttgctctaaatagtgttttcctggcttcaatacaaactctattggtcatgttctttgttaaaatacgtatcattctaaaagttcccatggcattagattttttgctcaaactacctataatatttctccaacagagtgcacatttgccttcctttcacacatacctccgccccctgccctgagcagagtcccagtggttcccatctgtttagggggtggggcaggggacacaggccctgacacgaggtggggccgtgccaagcgtggtggtcttgcacgggcactgagtgggtgggccctggagagaggagaggtcattccccctggggaacgccccaggccacaggggagaggtcagctggagcgtgaggtggggggcggagatgcataaagggtgggatggggcctgctgctctatcagcaaaacccctcacacccgaaggacacatagagggagggcactgtattcactgacctcacacttaactgtccattagcgttcagccacaaaataatagaacacactgacagaggcacaggaatggattgctcgcatctttatgacagctgaatggaggaaatttctaacaggttcagagaaaggatatcaagctgtgtttggagaaaggggtgggaattctaaacaatatctatggaagcaggacatctagaaccacagatgtattcagaaaaatgctagatctcagtactaccctagaataccaacagttttctgtggatggtatgggaagggtgatttcttccgtcggtgggctttgcctttgaaattctctctgacatatctacactgcattttaaaagtcaatattagtgtgaattttaagttaaaataaaatgttatctcattcagttatttatacatttaacttccattttcctttacaataactcagtgatacacctagccctgttttccacccggaccagcctgtgctgctacaagcctggtttctcttcctcatcacgacttactcagcttcccttcctgtttcagttcaaggaaatgtgggggcaggaagaaagggggcagctgccactcacagagctcacactaaatgacagacagcttgcccctcacgtctacctatttttctagttgaatttcattgcatgcagcaatcgacctcagggattcattttcccacatacgggaagctcggccccaggtagggggatttgcttggtgggggatttgaacccaagtccctctcactgcaaagcccacagcacccccgtgaggaacagacagggaacagggagtagccctggatcaccctaaactgacttcgggtttagagaaggacagattacctggggaatgaggaagctcattgctctggagctctcttctggagaaatgtcatgaatgttccctgtaaggagctggtggcaacttccgttaattctgggaccagagacctcaggacaagagccagatgctcattcatgtctctccaggcaagaggttctggccaagtttgggctcccagaggagtctaagaaaatgtggaaggcaccaatgtgtgtttttgaagatttatttcagagtgagcatcagcgacctacaagaacctgggacagaagccaatgcctcccgtttccctgtgatgtgaaacaggaccctgtgcttcctgtggacttcaagaaatgtggacttgagctttgccatcccttcccctgatcctgtttcatagattttgctgttatattctctgtatctttacagggatcgggaggctgaattagtgttattcagggttagtaactgtcccttccttaacggtggtggtcctgatagttcgcacatttttggctgtcccaaagagcagtgcaattatgaaggcgtaaatacgaccaaagaccactctcagatacatcactgattgctggctttgtttgacggaacgtgttctttttggaggtggcccgctgttgacactcccaccagcacctcttcttaggcacagtggaggatcccagcctatatggcaatggcagttccttctgttgttgcagactcctctatgaccgcacttctgagggtggcagttgtagcccagtgaagtgatagtcacattgcactgggtgttattacagaagtttccatgaacacaaggagtgccatctatcacacgcccaacatcagtcgtgtctgttgcatggtgttcatccagtccaaaacactgaaaccctcctctcactgagtgatggaatgaaacacgttcctgcagccggggaagatgggtcacattggtacactgcagtcttccacaaaacttatctattcctgcacaagcctggtagctgagatatgtttgttgtctaatacaatgtccaaatcggtagctttcaagatttatgtcatagcagacctcgggagcatcctcagcactgacaccaaagatcgccttgcagagcacattgcgatcagtgcagttcccacgatagcagtagccttcttcagtgcacggggttccatcttgcatataaacgtttgcgggacatgtcacggtggtcccgtgacagtactctggaaggtcacatatattttggataggtctgcagagagtccctggtggggagaagctgcagtttgtacagcactctcctatatggcagatgctccccggtgttaagtgacagtcactttggcagcaataactggcataacactgcttgaaggagccacagtcacattcctccctcccctccactatgaggtttccacagcgaaccgttgtcatggtttcgttatacacaggagcaagtgtttcaaaaacacaccggcctgaatgtataaaacaattttgtgcatgtccataagaacagttactgaacgcatctgtcatcccaggaaatcgctgcataatgcaggaggcccttctctgacatgtgcagtagttatcatcatactccagaccaatacttctcatctgtgtctgggttattatgacggctaccaataaataatgtctgcctggagtaccaatgtgtaacagggctatacgggaacagaagttatacctttcaggttcatagttagattcatgtggcacgtatttaataagtagtgtggatgaatgaacatgaaaagtatcaaaaaaagttgttttaaaataggtaaacattgcactctgaattcgatattcattcacaggggctgggtcacgattattatatatggtcaaaagataaatatagtaccgcagatcaatattttgagcaatgctgtcaatgagactgaacatctggaccacctctttggaacaagttgtaatattgccatatatgcgataatatgaattggaacattgaacgtggccttttatattgcctctatgagaactatacagcgaattagatatcctgggattcatgctgtcatttgcttcagagaacagggggtctgtctcattgtcatcatctctaaatgtgggccctgttgcgttgggctcggccactatctgaaaaacaacatgttcaaacctgcgggaatcctggaggggtttgatttcgtacgcaaggtcgtccagcctcatgatgcctctgaggtccccatagcacgtgtcgacggtgaccatggacagaggcacctcctccaggtagccgaggtactagcagtctggagggatgtaggggtcacccatctgcaagactccttggtcatcctgagttgtcaccagcagatgtctaggccaaagaaggtgtttcctccgcatgtgaatgacgtgtctttgaccccaaaacacaggctgtaggacagccagccgggaaactgaaggcctttgctatggtgtgtctccttcctgggaatcaccacctcggaggaggcatagtgccacaagggacggccttgagaacaccggaccggagccaggagcgcccagagccccagcagcaagaggggggtcctaagggtgacccgcgcctctgcccgcctcatgtcccagcccagcgatagtcatccaaagacaatgggaaaggaaaggactgtcctgggcgaagccaggccccaaccagctgcggtggctgcgtccctcccagggagaccctgacagagaacaaagggcctccccaggctcccgcaccacaccccggggggcacctggactccgggagggaatgaggtaacagtcccagggcggggcagggggtgggcctggacaggacggcagctgctgcactgcgggatgaggctgagggtcatggctgtgaggcctcatcggggagggaaaagggagagggaagcagggctgtctcttttaccaccgtcaatcttttccgtttctttctgaatctacaaaatgcaatgatgtgcgtccaatgccctcgcatcacccgtgttattctcggttgctctgtgggttaatagtgctcctttctgtggctcacactgcttactcctttgtcatgtggaggtagacactgccaatattttccttggggactgaatgtttttctactcttaataagtacccatgtcttattctttttgttgttgtgttgttttgttgtggctttgaagttttgtttgaagttaccagattgtgaaaggaaaatatcttgggccccgtcaagctggaaaccactcaggacaaatctgcctcccagtctatttaaagttgtccctctgctcacagagacaggtgcatatcctcatggcctcctttgcaaacacttatcagaaactcaaaagaatgcaaccatctgtctctcacctacctgtgacctggaagccctaagtggggaggacttgctttgagttgtctcagcctttctggatggaactaatgtccttcttacttatattgactgatgtctcatgtgtccctgaaatgcgtaaatcaagatgtgcccgaccaccttgaatccagagttcctggattcacaagatcaacagttgatatagggtaactttttcttctgtgctatgtaaaactcttgtgaattatgatactttttacttagtccatctattgggaacagatgctattcctgaccccatcagagccccaggtgctgtccctccgatgcttctgtgtggttctctcctggtctttggtcatttcttcagatgcaggagctgatcagctctcagggaagggcacagggggccctctgtgggtgtctcatgtctgagaactaacgtttcacatatttctgccaattctgtcattgcttatgaggggagggaaaatccaaggccagatcataatcagaaacacaaattactgtttcttcaaaagtgtaaatatttccctttcctggcgaatgtggtcactccatttaaacttaacgtgaccgtggtgtgtttcgaaggctgcgctgtgtggcactttgtcttccaacgccccgtactcccatcttccatcgcttcaaatcctgcctttttaccacagatgaacgattactaatgaagctggtttcccctctacgagtgtgcaggttgaacgccctttccctacccctttaaggctttcacagggaacagaaggaaaatatttgacatccctgaaggaggctgctagggaagactgtgttcctcctaaattcttgtgctgaagtcccaacccttggtcctgtccccacatggccccttccctgagatgagctcatctgtcctcttccccaaggtgagcacacctgtccccacgtggacctttccctgagacaagcacacctgtccccacatggacccttccctcagaggagcataactgtccccatgtggacccttccttcagatgaactcacctgtccccacgtggacccttccctccagaggagcacacctgtccccacgtggacccttccctcagaggagcacaccggtccccaagtggacccttccttcagacgagctcacctgtccccacgtggacccttccctcagacgaggtcacttgtccccatgtggacccttccctcagatgagctcacctgtccccacgtggactcttccctcagatgagctcacctgttcccacatggacccttccctgagacaagcacacctgtccccatgtgcacccttccctcagaggagcacacttcttccctgagaaggtggactcttccctgaggcaagaacacctgtccccaggtggaccattctctccgatgtgcacacctgtccccacatgcacccttccctgagagaagcacacctgtccctatgtggaccctttcttgatactagcacacctgtccccacatggacccttccttgagacaagcacacctgtccccacttcaacgcttctctcagatgagcacaactgtccccacctggacccttccctgagacgagctcacctgtccctacttggattcttgccttagacaagcacctctgtccccacgtggacccttccctgagagaagcacacctgtccccaggaggacccttacctcagacaagcatgcctgtccccaggtcaacccttccctcaaaagagctcacctgtccacatgaggacccttccttgagacaagcacttctgtcccctcagacaggctcacctgtccccatgtggacccttccctgagacaagcacacctgtctccatgtggaaccttccttcagacaagcacacctgtccccacatggacccttccctgagacaagcacgcctgtccccatgtagacccttccttcagaggagctctcctgtgctcagacaccaccaggggggctcagacactaatagggtggctcagacactaactgggggctcagacaccatcaggggtcctcagacactaatagggtggctcagacactaagaaggggactcagacaccaccagggggctcagacactagcaggggcactcggacaccaccagggaggatcagacataaggcggggggctcagaaaccaccagaggggctcagacaccaccagagggcgcccagcaaccaagggatgctcagaacctacggaggggcactcaggacctacaggggtcgctcaggacctggctcaggagcagatgcaaagtgaagctgaggtttccgttttctctttggggattccttgtcctgccctgcaaaagccttgctcagcagctattattgtttcttccctggaattccctagttcctctcatctgaaaaggacatagagcagaaatcccatttaacttttcacacttcattttcagtctccttctagcgatatttcagtaaaatattaataagaaataatgaagccacagtccaaatgttagcatcatgcaaagatttgtgtgtcttctccactctgtcagttatgccttaggaaactcttctctcaatccactgctcagtgtacactatgatgttgtgttttgttctttgctttcttctgctttgcagggaaatgaagcaccatttattgggacgtgtcctccatttctgatggactccccgtggtctccacctcagacggttttgccaccatctttaatccgttaatgccttcaatcgacctcaccatccatgtaatgaagcaatgaatgcctttacctcatctacttgtgtctccatgagtcagttcacttctctccattctcacaaaggacagccaacctcaggccactgcttcagagcctcctgcagccttgggtggtcaacctattaaaaagcccctgctgtttagaaaggatgtgtattggaaacttaatcccaaattccatagtgtccagaggtgggaatgttaagaaatgattaggtcatgagggctctgccctcatgaagcaatgaatgccattatcgtcagagtaggttactcattgtggtagcagattagttactacaggcctgggttcctcattaaaaaatgagtttaaacccctttccatccttcgcacctgctctcctgccttccacatggacatcacagcaagaaggctcttgccagatgctaacaccttgatattgacttcccagcctctagagctgcgagaaaataaatttcttttccttatactttagccagtgtgtggtattcactcattgcaccacaaagtggactaagacgaaaaatcagtatcaagaggtggggctgttgcgataacaaataccccaaaatgtagaagtggatgtagtaatgcacaaagactggaataatttggaggatcagactataaaaagtctggattgccctgaatagaacactagaggtgattcttttgaggactcagaagaagagagctgtgaggaaattctgaaacttcttagagattatttaggtgatgaccattagaatgtcagtagaaccgtggacaataaaggccgttctgatgaggtctcaggagaaaaagaagaatagctcatcggaaaatggagcaaaggccatccttgccataaagtggcaaagaacgtggctgaattgtgttcatccctaggtccttctgtaaggtggaagttcagagccatgaacgaggttatatggtgggagaaatttgaaggaaatctatggcctgacttctagcaggcactttaggactctgttcccggtgtccaggcacagcactccttggctgcccatgctgtggctcaggaggacctaggtgtggctcaagccatcactttaatggtacaagtcatcaacttccatggcatccatgtgttgttaattctgcaggtgtgcagaatacaagaaccacgagggcatggctttctccacctagatttcaaagaatgctgtggacggcctaaggtctcgggcagcctaaggacagcctaaggtctcgggcagtgacttgttgcagagacagagtcaccacactgggcccttagcacaatgccaagcagaaatgtgggtttggaggtaccacaaagagtttccagtcagcctaggagagctagaggcctgagagtcccacctgtgagagcggctgagtggactgaacccagaaaatatatagaggcaagactgccggaggccttgggggcccatccccctccccagtgtgcacaagatgccgttaaagaggatgattttccagctataagacttaatgtttttttccctgttgggttttgaactaggcaccgctttctccttgcctctctctgagctttggaatgggaatttctatcccatacctgccccattgttcactgtatttgaaagtagataacttgttttgactttataggctcgcagatggaaacaatttatatcaggctaaattgtgcctcgagtcacactcatatctgatttagatgagactttggacttcagacttttgcactgatgctggataagactttggagacaattgggatggaatgaatgtaatttgcattgtgataaggacataaattttgatattaggaatggaatgctatggtttaaatgtgtctcccaaagtttaggatctggaaataatctttaatgcaacagtgttgagaggtgggacctttattatgtgatcaagtcatgaaggctctgtcctcatgaatggattactgtcactatcaatggagtgggttagttattataggagtgaatttctaataaaagatggtctcttttctctcgtggacaaatggtctcttgctcacccacctctgctgtgagatgaggcagtgagaaggcccttgtgagatgccagtgccttgatattagacttctctgactcaagcaccataaagcataaattccttttctttagaaattgcccagtctctggtattcggttatagtaacaaaaagacagactgagactaagccattgtaacatgtgtgaggtgatatcttatcgtggttttaatttgcatttccctgatgattagtgatgttgagcatttgactctttatgttgagtgaaataagccaggtataaaaaattactccatgatctcacttacacatgcaatctaaaaatgttgaactcagagtagagagtagaatggtgcctaccaggggctggcgtcaggggcatgtgaaagctgagacgttggtgaaagggtacagagttttggttagatagaaggaattcgtttgaagatctattgcacagcatggtgacttccatgatactaatgtactatatacttgaaaactgataagagagtagattttacacgtttacaccataaaaaataagtatgtgaggtgatggacatgtttatttacttgatttaataatttcacaatgcccgcatatgtcaaaacatcacgtcatatccccataatatatgaaatagaatatgtttttctagtaagtgtgatgcctctgtttctttttctttcttttttttttttgggaacaaaacaataaacacctttattacatgggtgaagacaaaacaaggatttatttgcctttctgggccttgattttcctaagatagaactccaactctttgccctctagcacatagccatctgctcggccacactgtcccggccttgaagccatgcacgcaagaagcttgccctgctggaactgctcccccaggagactgctcattttggcattcttcttcctttcatcatatttcttctgaatttttttagatcgttttttgtttaaaatctcttcttcctcaggagtcagcttggctcccttcttgcggcccaggggcagtgcacagtgggactcgtaccactgtcggtagggcgtgctgtcgatgggcacgatgcaattcttcaccacggtcttggtacgaaccagctcgttattggatgcattgtagacaacatcgatgacccttgtttcaccagcgcagcattctgagccccaggagaaattccccacgtccagcctcggggcacagtatttcttgttacctcctcgcacacggactgtgtggatgcggcacgggtcagtcttgctgttggcagctgggcgccccaactcatacttccgcttcttgtggcagggccttctcttgcccccagctttgcggcccttgtgccagttgtcccgagaggtgcccatcgctcggcgctggctggaaagagggcctctgtttctttaacaatactttctggagattgtttttcccttgagcaatgtttcctctctgctgtatttacacagttttcctttcccatgggttgatttaagacagtgacaatttatttattctatgtctggtaatttcactgagaaacttaatgaatagccacttgaaaccatctggtgccactgagaaaccatctgaaggacacagattttctgagtgtaggccacaaccatattttaacactttttaaattcaaaatcggggtttaaattttgatattttactatggcttctttgattccctcccaagatctaaccattgagcgtgtgaaaagggctgggacccaggttacggctgtgcttggcatgatgacgtcctgcagaaattcctttggctttctacatggagctcagcctccatatcagccagctcaccaggaggtcagagtacttttcaaagatcctcattgtgttgtttcattgtgagaggtttccagccctcgtgagacaccccttggttttacagtcatcacgaacttgtttacgattccgaaaacatacctgccatctgtccatatgtttgttctgcggcttttgatttgctaaaatgctgtagtaactgcaataagttctaccatctggattaattttcacctcagatggaagagtatattttaagataaagataaaatagtaatagtatatcctccttggtagtatccagttctatactttgagctatggtctgtcaataaataatgttatgccagggtcctcaatggagtgcctgaacatctaaggaaggtacagaagtttccctaactaagatagaaaccatggtgagcacaagtttgctatgcatccatgtctccggtctgtctcactatgcacctgacactcattttaacctcaccaggaagtcagttaacttccaaatcagtttattgtaatgcttccaggtaattatatgtggcaatttcaggcagaaatgaataaaaatcttcaccagagaatctaatacagaagaatgcaagaggccctgggcttgttttcataaaagcatcatacaccaggcagttgattctttcagctgttggcactggctcacccagcatgcgggcttcatcccctaagtaagcttcatcatgcatggataggctggcgcctttcctgaggccatatgccgatggatatgcagcactgtgccacacgtccacagagatacaaaatccctgatgggaagaacgaggctggatcaacgggactggcagtttctcattgaggaaatgtgaggtcagtttctatggtgggcaattcaggaaattactcagcagttttgtaattgatggttatggaaaaatgaaccgttgagatgactaatgacttacattccattattccaagtaagaaacggacatcacagttcgctgtaactaaattttcataaccaaatggattactttaaatttcttcctacatcttctcttaataatttttaataacgaatgtgtcttacctatattcccaatatttaaaactgggttgtccagagagtctagagaatttgagaactaggaacagtgaaactcctgtatgttcagcagctcccaaagcaacacaatattccccaggaacactgttctgtcctccagcataattcatgcttgtgtatttcctaatggctccaatagtgaccctccattcccaccaaacatttggcctcccctctctccacttcccctccattcatacattacactctcagctctgtctagggtgtcataaaagccagcggacggaccctcctgatctcctgaacatgaaagccagcactatcatgtgatgggctcctcttggcatggtgaccttcaaaggcacctcatttaaataatcaccttttttttccttctgtaacaaagtgtttctttccattgtgccttcccataagcagtttaacataatttactgtccgaccacagttattaatacacacaaatgccacaacctctttttagcccaagagacctgattaattcttctttggggatgagcacaccctagaaacacatcccattcagataaacacgggcacaccgatgacgtgttcttgagtctacaccattctccgtccaactccatgagcccctgaagaccaagacaggctctttcacacctgtgcaagctccggcccagggacggcctgctgaggaatgggctcagctgggtctgggtgctgggttcatctcttcccctctcctgtcccaaagcaggtccatcaccctgctcaggtctgaacaggagtgtctaggtttttctggccatccgactttttcaatgtatagaagctctcctattacctactgtattcattttatagggcttttataacgaaataccacagatcggatggcttacaatacaaaaccaatttcctcacacttatggaggatgaaagcctaagatcaagctgccagctgggtgggtttcctctgaggtctcgctccctggcatgcagatggcgccttctcactgttctgtggtaacatggccgtccctcggggcctgtgcaccctccctcctgcttcctcttcttataacaacagtcagattgcattagggccccactccaggaatctcactttaacttattcacctctttaaaggacactaatccaagtatgatttcattctgaaggaccaagggttgggacttcagcacatgaatttaggagggacacagtctcccctagcagcctccttcagggatgtcaaataaaaggaataaaaggacactgatgctccagaaggccttgagagtttgcagctgctttgttgtggtgggacgtgggtaggcctgcaccttatctatgatggcagatggaatgactttagttttacccaaccagatgacaccaactatttgactgataagcctggaccctggattttgtctgtattaacctcccatcctctattcagcaagtgagacagcaagacaggggctgtaatttataagctgaaaaaagactcagaggttatcatgataacaccaatgtagtggaaaacatgtatcccctttgggtcagcccatcgactgaggttggaggtcactaggctgtgagatttgggctgtgtaaatatccctggaacaagacagtaaaagtccattgttctttttaggttaatgcaaattgatcttgactctggggcaacagaaatgctgaagaaggtattgactaaactgataaggaaatgctacgtggctaacacctctcctattctcgtcagactggaggagatattaggaacagctgcattcactcgggagaccaccttatttaactcccagtaatctactgtcattctccatgtctcaactggcctctgcatgggccatgcaggtctgttgtaggaaccatgcagtggcctcctaatgcctacctgggctagctccttaacaatcttcatgattggatcatcttcccctcccagggcgggtggtgttgctccagctgtgggactccccatgggttggcagctctactggcatccagtttgccttctgcttggtcacacatatcaccactctaactctccgttggaattccctggccgttgtttggagggtcacgcctaagaagatatccattctcatgtgttctaggatggaagctgtgtatactacacagggtctgggtggcagtcccccaggtcgtatcactagttcaaccggtctgacttccgtggcccttccataaccacctattgccgctatgggcccagagaactggtaggtgttgccagttagagcacattcgttgtctggccaccctgactggctccttggctgtctctcttcctttggtgccattgttcttcatcacagtagggtgcatcccttgcttactcagtttcttcttttctcctaagtcagcaactacctggggcacatgaaatgttggctgccctcccagggggcttaacgtggaaatcagtgcaccatgccattgggtaggcactgaatacataactgtagcttttattttgcagtaaacaattcattgttgggacttcaataattctcagcataattagcatgcctcatctcgactcccagaagatatcctgcaactcttctatagtctgccattgagaacgagctgtgggggcatcttcctcattggacccggcccccttggagcctgcaaccacttaccataaaggtgccatcatagggctggatggtttgtgatgggtgtcattttactcatcttgagtccagagagtataatactctccaccccctatcccatagagaagccaccctgtgatccactctctccccttgtgtctgaatccaattctaagctcccccaattccacagtggtggaattccgcattgtggtgcactgccttctcttaggtgggggaaagttctgtggggctaacttctgctggcacagttggcccacttttatgttggtggtgaccaccacaagtaccatttggctacagactgtgtcctggcattccaaggcttttgtgtctggaaggcatcctttagccagcctgctaaaggttgttccggatgtggagtggccctctttgtcacatcctacactcgtaaggcatgacatgtagtgcagttgctactcctaaacagtatatctcacttcagcttccttctgtctttgagaccagggtcttagggacacacacttatgtccttgcctttaacacagtccccacctaaacccctcagggtaactgactacatccaattcacagggctgtccctgcactagaactcccaaggtttgtattcatttcactgtgacttcagcttcttcagagccctcatcctcccttttggaacagtcgcagtggggcaccttcttgtctaagtgccatgggggcccaaggggtttgccgaaatggggaataaaggatcgccaatgtcccaggaggccttgggaggtttccaactgctttggtgtggtgggacatgagtagacctgcatcttatcttatctatgatgaaatatggaataactatagtcttatgtaaccagatgacaccaagtatttgactgataagcctggaccctggactttgtccgcattgacctcccattctctgttcaccaagtgagacagcaaagcaggggctgcagagcaagaacctttatggactcatcctaaccttcatctccttcccactggagctctacatcggacgccaggacttaggctcccaggatgacgtagtcatagtagtcctaatgcattggtgtggcagtcagcaacactttaaatggcctaccaaataaacaatggtctccaatttgctatcctatccctacaggcggcatctcattatagttacaactgttctcgtggctgacacaccctagcctgtgcaatgagctctgcctcagtggttgctcagagtgcagtcaggagtggccaacagctgccacagctcaggaatctgactgtcactttgtcacattgtcacatccacctcaggcaacaggtcctccagaacttttggcattttggaggcatccccgtacacatgcagcgggccccatccatcaaggattgcagctgttgggcccacagagatgtgcatggcctgcctgggatttccccacaggtctccccttccttgacactgttgtctaagagcttgcaggattttctttgaccttgttctgggcctaccagttgtcatgctagacccctattgactgtaataggcatggcaccatgtccaaaaggctgaagaggagacctggagcccatgaacaagacctagggtgtattgaggacttgcatacaatgtggcccaggaaaagtgtgttggacaggaaaaccactaccatttgtaaaacacgtgtagtttatattatgattttcacttagcaccctctacctagcaacctccagatttaacaaagagcatcaatcacctggacatcctgtgttccaagggataggccagggattcagatgtccttcacagacaaggaataaacttctgggttgacagctcctggatttcttagctcagagctctgaacatacattcttcataaactatagggtcattctcacagtgtgcttaaattaacgctgccaggcatttctggcatacatagatctgaacacacacctcataaaacaatgtataaaaaagtgttcatcaagactttgtattaagaatatgtatatttaaaacaaccattaaatactgctactcatttactataatattacaacggctgcacagcaaagcattagtgaatactgacaaggctccagaaaagaaaatcttattcactgttggtaggaacgtaaaatggcacttcctttttggaaaatattttcagtatttctttggagttaaacatgttaattgaacagatgactctaaggtactttattcaactgtttttttgttttgttttgttttgttttgttttgagatggagtttcactctgtcgcccaggctggagtgcagtggcgtgatctcggctcactgcaaccttcacctcccaggttcaagcaattctctgcctcagcctcccgaatagctgcgattacaggcacccaccaccacgcccagctaattctttgtatttttagtagagaaggggtttcaccatcttgggcaggctgatcttgaactccttaccttgtgatccacctgcctcggtctcccaaagtgctgggattataggcgtgagccaccatgccttgcctattcaactgattttaatacttacttctacacagatactttcatgggaatgccggtatcagctttcttcagtagagcttttcctcctccatgaattttgcttatagggtgataattatataaacaattcccatataattgggccaggcgcagtggctcacgcctgtaatcccaggactttgggaggctgaggagggtagatcacctgagatcagcagtttgagaccagcctagctaacatggtgaaaccccgtctctactaaaaatacaaaaattcaccgggcatggtggcgggtgcctgtaatcccaactactctggaggccgaggcaggagaattgcttgaacctgggaggtggaggttgtagtgagctgagattgtgccgttacactccagcctgggtggcagagtgagactctgtcacaaacaaaccaaaaaaaaaaaaaaaaatgaaaaaactgaaaaaacaaagttcccatataattagagtatatacttctattgttactttttttcaatttattaatgacatactgtaaacaacattaaaaataataatccctttcatttctcagccccagcacagctgcctcctcccttgggtttctgacaccctcaggatgtgggttttcacactgtgtctctcgcacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcctgtggagagaacacagaagtggatgagatctccctggactggactcaatctctttctcatcactgggactagggagcctcttacctgtggctgctgccaccaagaagaggatcctccaggtccagtccatggtgaggaacggagctctcaggggattctctagaggacagatgtggttgctgggtgatgctctcagggcacaggacagatctgtatttacttcagtaaatctcaggttatttgcatattcatgagggatactatttcatagctctagacttgatccaagatgagaaagagaacacacataatttatgggccatgcaacagtgggacgctgaagtccctgtcccaatccttgtttaatgatgtgtgtccccttgtatgcccagaactctgctaaaatagattgtctgctgaaaacaagttcccgcagaacatggtcctccaagtgaacccatacttaaatggcactttgacaccttcatacttttctgggctttgctttctgcatgtcttactactgtctctgttaagattggcaagcactgaattaataaaaccatcccttttctccatctcctacctattaagatatctgaaaatcctagaaatttctccttttacatgtgattctcattgacttgttaggttagataaatcctacaaatagaactgtatactgaaagacacaaagacacatcaatagtctttactaaagtcttgtttaacttattaaagcatgtttgtccgagaaaaggaagacatcagaccctgggaggaacccctccccagcctcccttgcacctgctccagggctgcagcctgtgctgggcgaggccctagcgctccctgccacccagaccttgcactgcagggagcttcccattgggtctcacagagcatttttctctcagcctctgtagctcactaggaagtgactgtgccctggctcagaatgctccttcagtgacaacatgagctgatggcaccacttcttgaaatagtgaatgggcctttggaaacccaatgtcctcttcagggtggctccaagagaagaatcgctaaaatcaccagggagtccacttcctggaggtctagatgcactggatcactggaaacaaagggaggctaaaactctgggggggttggaggtggctcttttctcatttcggctcttgcagatgaatactgcatctgagaatacctgaagctgcagatggatgtggattaaagctcactccacgtccgctgttccaataactcctactcaaacacacagaaacacaaacacaaacattctcacacacactgtggctgattttcacagttatggacccctaatttttccttcttcgtagtatcttactcacgggaagtgccgccgaccctgaccctaggcctcagtatgtgactttctttctcaaacagatctaaagcaatcacactgccctctttaatccatattaatgatgctgttgaggaggtaatgtgtggggcaggggagcatggtatgttcttacagttgactctccctggtttggttgccctcttctcctgagcagtgaccttcacaaggaatctccagtgatacagctgattttctctctttcctcccttctgcagatgctgcacccagggctaccgccttgaatctgactcctcttggctaattttatcatttgcgtgatagaggaaggctgaggaggaggggtctgtaatttggaagtatttccttcccccacataaactaagattttggagaataccttcccttggatgagctttctagaaaagtctttttgtgcatcttttctccgtgattactcctccccagttcatggctatagggaatctattttaattgcttccacgagaacctgaaggccctggagggcaagtccacacaagtgtggggtgtacagcctctaggagtgctcaccctccccctagtccacatttgtcctccagacattcagcataatcaccaggtaaatgttctcaccaatgtgtctccaggagcttctcttccaagtcagcaagtctctgctgtgactgtggatgtgcctgtctctacagcttttggagggagtagttttttcagcaatttcagctcttagatggattaaaaaatacttgatatttagatggtttggagatatatatatatcaaaatatatatgtgtaatatatatcaatatacatattatataatatatgaatatacatattatatattatatatacatattatatatcatatattgatatgtatgtataatatataaaaatatacatatatattatataaaatatatatatgatatataatatatatttattatatatatatatatatatatatatatataaattttttttttttttagatggaggctcactctgtcgcccaggctggagtgaagtggtgcgatctcagctcacttcaatctccacctcctgggttcaagcaattctcctgcctcagcctttcaagtagctgggattacaggctagtgccaccacgcctggctaatttttgtatatattttttagtagagacggggtttcaccatgttcaccaggctggtctcaaattcctgacctcaagtgattcctctgccttggcttcccaaagtgctgggattacaggcctgagcctatgtgctcctttggttcagatgttttttgatgtagaaatggagctaatgacttttaagatcatcacatatgtcagcaaaaccctgaagtcccctaagaggtcatgtgtgttctggtactggaagcagaaccctaatctccctacacaaaagtgacatctggacagacacaactgaacatgtggggacaaagggaatggcacagcaggacacttatgaggaagtttcaacagtttcctttttattcagaggaagctgcagcaggtgagagctggttatacctcaggcgatgtcattttctggaaggctgttcttgctcttgtgctggatcaagtggatgcacctgggccctcacacctggaacaggaactctcattccttaacacaaggtgctcggtgagacagttgcttccagctgaagtgcagagaaaggggagagaaggagttgtctctggtgtcccaggatgtgtgtcaactctaggataaggtcaccttggaggggcagtggtctaccttaggggattacatcagttctgccttcaataacctgtggctgtggtcaggagtgtgactcatccccttctgctcctcctacctgcctttcattaaatgtgcaatgaatgagtgatccctcaccagagagtgtcatggtctaaacatcatgatctcacacaataacatccccacacccaatctcaaatacattatagaccccactcaatcagcaattggcaaataatttgctcttgtagatttggtgaatacatttgctcagcgttcatttcaacagcctctcagccacatttagcaaagtgattgacaaaaatgaacatgtctctatcagcaaatagaaaatataaaatcaccgagttggttgaaacgtacactattaactctgaacaaatataataagaaattaggcatatcacaatggcacacagtttgttttaccctaaaaatatcccctgagctttgccaagtcagtctcttgtctttccccaaaagccctgcctatcacaaacctgtttttaaaatccttttaattttactgtatttagcaggtctcatgaatggaattgtacaatacttagtctcttttgtccatcttccttcacttagaaaaaatgttaaaatgttgtcttctgaattaataacccatagtttttatgactgatagtattccactgtatgagtatacaaatatttgagaatcaattctgttgaaatacatcatgtttacttttgtatttggtaaatatgagtatcagtttatgacaattgatactgaacaattttatatattcttattttcagataacattttttcttggtgaggtgtttgttcagattttcactcattttagaattctgtttatattatgctttctgttgagttttacaaattctttttatagcctagagacaagaccttacaaacagtaaaaagaaatagtttctgattttgaatagattcaatatacatacataatttttaattgttataagcacataatagtatatatatttctatttgttgggtatatgtgatgttttggtacaggcatacaatgtgtaatgaacaaagtaaaaaaaaactacaataaatctataaaacattgaggaaataaagaggacacaagatggaacaatattccatgtttatgaattcaaagattcaatattgttaaaatgtccataatacttaaagcaatctacagactcagtacaatccctatgaaaacaacaatgatattcttcacagaaatttttaaaaaatcctaaaatatatgtggaaaaacaaaagatgcagaacagcccaagccattctgagcaaagagaacacaactagagaaatcacattacctgacttcaaaatttatatttttattattgttaattatttgatctaaaagttatgtttcaaacaatgagaataacaatacgttaaatgagtctgatgtatgtatacttgaaattaatggcatcaattttatgaatgatggaggtaattgagaatgttctgtgtgaggcacctgcactagatttgatgtggaataatgtcattttgaagatggagacagattagttacacacgcatattgtaggccatggtgcaaagcaggctcaccatgcaaaagtgaccaaaacgaggccacgtgggttgtacacctcagcagctgtgttacccactgggacaaagctctgaaggacatcctgcctccaggggagagaagaacaaagcccagggtgtccctggctgtttttccctaactcaagattttatatcctctaggagaaacaggaacaaacctgagctgttccagacagacaggatgtccttggctctgtgcacgttcaggaacaagatcaactcgttctgagtctctattcagtgatttaggttcggggaaataagaatgcagatctgaaattatggagctttcagaaggttttcatgtgtctcagtgcaatttcttcatgtgttattttggcttatggtattgataggcccacaaaaactagatttaattcaataattcaagtgatagagcaaaactgaaagagctgaggggttttctagcaggatttagaaagtttaaaatacttcatcttagaaaatgtatttgctggacattgatgggactggagtagagatggatgtgggggagcccaaggattgtgctttcacacacaccacaatgacttctgctgtcccttccttccctctctccctctctctctttctttctttcttttctttccttccttcttccttcttctttctttctctttctttctttctttctttctttctttctttctttctttctttctttcttctttctttctttctttctgtttctttctttctctctttctttcttttcttcttttctttctgctgagtgagcacagaagtacacacaggtataaaactcactgaatcaccattagctgttcttccttttgcctcccacccaggtcaggaggaattacaagtcctacggaattctagttctaagagagtgagaatctttatatggctgattattccagaattttctataatgatgcagctgttgtttcttttagccagtttttattgaattctgttcttttccattgagtcgtaaaacttatttctatattctgttgcaagtttgttttaagatatatatatatatatataaaatattcttgaaatctgaaagtttctgttcattttcttaatgtaattatttaaatatgaaacttattttattataaattacaaataatttttgcatatatttatgacatatgttgtttagttatgatacatgtatacattatgaactgggtaactcaagccgcttatattcatcacctcacaaatttatcatttcttagtggggaaattctaatgtttatttttttagtaattttgaaatatatactaccttatcagctatagttgacatgctgtgcattagaaaggcataacttatacctccggtctaactggaacgttgtgcactttaacccacatctccctttcccagtccacccctctaggccctggtaaccaacattctactctacctctgcaagtctactgctttaatatatacagtgaaatcatgaatgactcttcctctgttcctggcttgtttcacttggcataaggtcctctagattcatgcatgctgtcacagaggcagggtttccttcttatttaaggatgaacattactctgttgtgtctgtatgcattttctttattcattcatccattcatgggaatttaggatgtttccatatctttactattttaaataatgctgcaatgaacgtgaacatggagtgcagatatctctttgacatgttgatttcatttcctttggatacatagccagcagtgagactgctggattctacagtagattttgtttctttattttttgaggaacatttatagtattctccataaatagctgtattcatctacattttcactctccatattctgagttctgtttctgtcatttcagccatctcagccccattcagaactgctgttgaagaggtgctgtggttgtttggaggaaagagggcgccctttttgttttcaggacttttgcactggttctttctcatctttgtgggcttatccaccttcaatctttgaagttgctgacctttggatacatttttattttcttttaccctattggatgaccttgagggtttgattgtggtataaggtggattcagccaactggcttcatttctggaaaaatttaggtggccagtgctcagctcccaacacctagactgtgtgctctgactctgggggaagttatactagtccctgacttggttctccggctccttaaggttaggaatccactgtcctgggctgttggaggtgtggcagctgtggcagagtgctagtgggtgtctgggtgcctgcctccctgcaggtgttcgccacagtggcagaggcattgcgtctgtggggccctgttggtgactgtgttcaaggtcacactggaggaggtgttggctcagggatgggacacttgtgggcacaggcccgggtgccgtattcatgccccacaagcaggagtgatttctgaatgtgtgagatgatctgctattctctgtgcagaattagcgcaagtgcgggacgctgacaggagcggccctggctttttccccaccaaagcttcctctgccatggtggttggggtggggggaggggactgcactccacgcaatggtgggacaagaaaagcaaaacccacctatacagacatgtgactgcaaagtgatgtgggaagttacgtgggcctgggtgaacctacagtattcggaggaagtgtgtaagctggtgtgtgcacatgagggctgcccgattggagctctccaccagtcaggcatgttctgccagggcagaaattttggtgcgggatcccagggcgtccaagactgccctgcaagaaggtgtggccaggctagggccccaggagaggccagtagatggaggggcactcaggtccctacattatttgagaatgtggccatgttttatgtgaatgagtgatgacttgattgtaatgcagcattttattccagtacacaaacatatctcaaattgtttaacattcacctgtaatggatattcaatgtgttctctcagtttctggcttttatacggaaagcagctattcagtgtgggaatgtgaaaaaaatgagaaaactgtgattttattctgacctcattaacaacgaagctgaacagctacaaataaaagagagaaaaaacattcaacatatctgagttgatttcaccaagcaaacaagaaaactgaaatctgagaagataggagcctgcagagagaaccaggacctacctgctagtgtacgtagggcaggtgccactggatggcatttgagatagaaacagactaacctagaaatacttaatgacttttttttttttagtatgcatgtactaatggtgttagattggcctagtgcttgcaagcttttcctagagaacttgaaaaatccacggacaacttcctcatctggtgtcttgtggtgttgactggggaaaagaacagcagctcctgtggaatgcctgaatgcacctccactacctccaggggaaatccaccaaagcatgtgtcatatgagctgtggtgaagtcaacagaaacaaaaggaaacagacgacaccaaggaaacttgatccagaaacacctcccatctccttcctcaggaaagaaatccttactctttagggtaaggatagtgggtaaaaagctggggacactggtgaaaaacagttgtgtctgggaaaagacgttccagccctggggaaagagttaaggacaggacaatgtggaaggccactccccagaactatgcttactactcctgcataagaaggagactcagtcagaaggttggaggaagtcccgctttgtccaacctccttcaccacacagtcatcaatttaaactgtcagtagggtgcactttccacagctgaaacagacagcctccctggggaaaactaaatataaagacccaggatcaaacagggacacaaaagcaagtatcatgggaggaacttgaaatctctgtggacagcagaagctgacttcaactctgataattgtggcatccataaattgcaaatatagccctgaatagatacacacaaatatctataatgaaggcccagcagaatggaatgtgtgaccatcttcaggaagaaaataatgaatacatgagtacaagaaaataaattacaaattaaagtcaaactggaattctatatatattaaaaatttcatttaaagcgaaagtcaaatgaataccctgtaagacaaatcgattctgagaaaatttattgctagtgcattcatccttcagtaggtgctttggcaaattttctgccagggtgagtagccatatgatatacatccgaaacatgaatctatccaaataaaacatgtggtcaagaatgaaaaaatgaagttgaaatgtagtttttatatttttaattgttctaatatatgtctatgtaatgataaaaatgcacatattatattttatagcacatataagtgcaaactgagaataaactaagacaacggatgagaaagagtgtttagaagaataagttataatagctctacaacctatgaagaggttttacgttatttgaattagaatctgattatacacaattcttattgtatatcttagggccaatacaatattcataaaagatgaactaaacaataagttaatagagaaataaacatgatcataaaatgccaaattaaaacagaaattaacagaaaaatagtaataccagttttaaaatagaattattatagttgatttaaaaagcaagacccaactactagctctgtacagaaatttgctctacatagaaaagttaaatacaggaaaacatggaccatgaaaatatgaacgaaaagaaagcgtgcttagctatgttaaattcagacaaggtagacataagactttcaggaatcaaggggcatattacatagggtaaagggatcagttttctaaaaggcatcaccaaagatttaaccaatggatctgggatagaaaataggctaacatctataacagatagcgaattcgacacttactgtgattgacaaaacaaacgtgataaaataggtaaatatataagtgaccagaatcaacttatttgactagtttcatttatagaatattcaatgggaagacagcaggaacccaaactgtgattaaccagaagatatgagaggaacatggtgactgaatttgatgtggttacgtgggttgaacaaagaaacaaacaaaaagcaataggaaagtgacaccttatctcaaaaagaaaagaaaaaggaaaaaaggaaactgttaaaaattggcaaaattcaaataaatcccagagctgaataaacagaaacttatcaatgtaaatatattagtcccatgtcccatgttttttttgacatattaactttagtgaaaacttggagatggatgtgaacacactgtattttccttacaattgttctgataacctataattattccaaataaaaagtgtgtaaaatataaagtaacaatcataaaaataatagttcaaagaccttataaaataggcttctgaaaataatattgttactaaaattattatggataattatttcagaggataatcctgaaatgatcatcgaagtggtggacagatgtttatttatttcagaaaaagatgtgaggcatctcatattaaacgctagtgatggaagtgtttatagagttgttttatcatctataatatgatggatgaaaagcattatcataagcatttgatggatgaaaagcattactatcataagcatttatgtagccaatatcatgaacgtattataatttcctcagttgtgcaccatttttgtgttaataccatgtgaacgttttctactgcatgtgtcatatctaaacatttgaactagtttgtttgttattaatgtgactcttgtaaatgctgtaggcattgctgatgttctctgtaatttctctactggtgtttttttcctaatattttaacatgataaatttggattaatataactacgtaatttaataatatattttaaacttcatagttgtacacacagacacacacacacacgcacacatacacaacagcccagcaatgacacatatacccgtccatgcaaaaatgaatgtatattaaacaccaaaacaacacacccatttttttctatattattttaattatttaattgaatgtaactcgtatttgcagtttcatttttgaatgaatgtaaatgccattcttgccaaatatattacttaagtgtacaatggtatttacttttttttttttttgagacagagttttggtcttgtcgcccaggctggagtgcaatggcgtgttctcggctcaccgcaacctccgcctcccaggttcaagcgattctcctgcctcagcttccccgccacgcccagctaattttgtatttttagtagagagggggtttctccatgttggtcaggctggtctcgaattcccgacctcaggtgatccacccacctcaccctcccaaagtgctgagattacaggcgtgagccactgcgcccagccagtatttactttttaaatatcagtcagttattaataaattgaataactaataagacaaacatcacttaaatttttattaaatcattgattaaagtaacattgtatttttttaaactaggcaggatagaacttttctatttgaaaaactttttaaaaaactttttggcgttaattttcaatacaaactctagtcgttatttgccaatatgcctttataataaagaacatccagcaataggaaactgaaagcagcccatgctttgcaggattcaatcacaatggcagcttgctggagggtggtctgagagtgggcaaacacattagggatttggacttcatgaaagcactactgagcccctgggctgagcacacagagggtagcataagttgcagagcctagtctgtggtacttagggaaaaagaggaatgggtgggggttatgtctgcaggaccctagaaaagtgtgatgagggcagagggtctgcaggtagagtgtattctaaggagaactgttactctcctaaacttggttggcttcagtgatcatgaaaagaagtgaactgatttaccagacatggaggacaggaagtaaaaggacttcctgtttcctgcatggagactgaggaagataaaatattttgacagaaaaagagaagatggagaaagtttgagaagcagaacaccaggggccaaagtggaggacaggagcccttaaagtggtgtttcatctgcacaaacagccgatgaaaggaaaagaaactggaccccatgcatatgctgagttgttagaaaagcatttacaatagtgtgtctgacagcacagaaaacaaaaaaattgtgcatagagccagactttggattgaatatacacaattaaaaaaaatatactgagatatatcattgctagtataactctgaaaataggcagagttaaaagttgaattgaacccctgttctaagttaatgttttataggtgaaagaaaccatgagttacaaggaagacatcgtaagagatcctggggaagacttttgcttgaccaggtcaggaatcaccaaggtggaaaaggaaacctcatcctccccaggtacctgatatggagctgcctccaaagagccccttggaggtcctgagtgctccctggtgtcctgagccattcttgctgtcctgaacacccactggtggttcctgagtgccccctggtggttctgagcaccccctggttttctgagcgacctctggtgtcctgagccccccctggtggttcctcagtgcctactagtgtcctgagcgccccctggtggttcctcagtgcctactagtgtcctgagccccccctggtggttcctcagtgcctactagtgtcctgagcgccccctggtggttcctcagtgcctactagtgtcctgagcgccccctggtggttcctgagcgccccctggtggttctgagcaccccttggtgtcctcagtgccccctggtggttcctgaacctcccctggtttcctgggcaccctctggtttcctgagcgacccctggtgtcctgggtgacccctggtggttcctgagcgccccctagtgtcctgagcatcccctggtggttctgagaccctactagtgtcctgagcgtcccctggtggttcctgagcgcccctagtgtcctgagcatcccctggtgtcctgagcgccccctggtggttctgagcatgccccggtggttctgactgccctctggtgtcgtgggcgccccctggtggttcctgagcatcccctggttttctgagtgtcctccggtggttctgagcacccgctagtttcctgagcatcccctggtggttctgagaatcctctggtgtcctgagcaccccctggcagttctgagtgccccttggtgtcttggtcacatcctgtggttctcagcacccccttgccacagtctcatgagtgccctttggtgtcctgagcgccccctggtgcttctgagcaccctctggtgttctgagcaccccctgcttcttctgagcgccccttggcggttctgagtgccccctagtgtcctgagtgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcacctcctggtggttctgtgcaccctccctgatggtcctgagtgcctcctggtggttctgagcgccccctagtgtcctgagcgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcgcctcctggtggttctgagcaccctctggtgtcctgagggccccctggtggttctgagcgccccctggtgtcctgagcccctcctggtggttctgtgcaccctccctgatggtcctgatgccccctggtggttctgagcagcatctaccacatagtcccctcctgtctccctgcggtgagctttgtgtctgggctcacacagggtttccctcactgtgtcactcacagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaacacagcaaacagactgagaacagccccgtgaggagaagccacagctggacctgatttacgaaggacactaatattgacggggatgagaagagaatccagatcaatgcagaccccacggtgtggacactgaggaagggcacagacatggggtggctcctcgccagggcctgagggaacaggggatgagctgcctttcatgagaagtggaggggacacatttccacgtctttctttttgtggtcatgggtgcactgctcagcattgctcatccatcctctgtgtctacatttcagggaagtcaaggtcaaaggatttctgggtctggatgcacagagttaatctgcccattactattttttattctctaatgtggacactgttggggtatcttcataatagcaaacattatcaacaaatatgtccagtaagaacataaaaatacgtttccagagaaaatggacacctgtctctaattggtatatttagagctgcaaactactgttcttgacaataaggcaaagttaggttgcaatgaaaaaaatacagatctatgccttgtcagggagggggtttatgattatcattatcttgagatcattttgccacagaacaattcgacattggatatatgtacttgtgtaaggaaacagtcaatgtggacatatgtgtacttatgtgagtgaagagttcacatggagacatgtttgcttgtctgagacaagagtccacatgaggaaatgtctgttttctgaggaaagagtaaatgtaagaacatatgtggtagtctgaggaaagagtccacgtggggacatgtgtgtttgtctgagagaagaatccacgtgagtaaaggtgcgtttgtctgacagaagagtccacatgttgacaggtgtgtgtacccatctgagggtaaatgcccattcagggacagtgtatgcctgaactgagctgaagtttggggaaatatttctcaaccaaggaaagaaaataatcctgtgggttatttgcttgtcaagagaaaaaaacctgggtcacatagaaaattgatttaaaaaaaaaacaatttaaaaaattaaaggtctttagtgaatggcaacatcttatatgcaaatcaggaaaattacctcattctttgttgcatacatctcatgaaatctccaccctcacaaaataagtaatgagataattttatacaatctgcatttgatccttgggttaatgaactgctaaatttttttttaattgtatatatttaggtttatattttccatcacaaaactatgtgcttagacaaattaattgtgtcatatctgaaccattgcatatcactaaaaataattttaatcttcttaaacagtgtctttttaacttattttataccagtctctaaactcctcgaatatcctctatatgttgttgttcacttgactacagttttggcttttatagaatttcaaataaatcaaattatacagtgtcattgaaatgacctcactgaagaaagtggaaaatgaagttgctgacctaaggaactttgaaaatgaggaaactctgtaagtttaaagtgtaaagaaactgaacataagcactctattctagtagataaacatgtttcctacaagggtacagctttacatttctgatactgctatgcatgtgtcctgaaattgtgcagctaagtaataaaatggcatatggttggatggggttcctcattttgcagtgagaggttatagacagtcaaggaaggaaggctagaaagatccatgtggtagcataattgggtagagagaccagtgtgttctcatttttaatgtaatcacattacagaaggttagatacatagtttactaggccagttggttgagaggtcctgcaagtacttataccacattaacaatgcacatacccagtattacaattttttaaatactattctttaacatcagaagcaagcaatctttagaaaaatggctgattctatgtatgaaaaagataatatagaaaatgagtttagaatttattataatagcaggaaacagggaagtgttcaaaaacaaaagcatgaggtgagctgtaaggatgcaggatccaaactcaatgagctcccagcacataataaagccgtggtggtttgaaaaataaaatgaataatgtagcatggatcttcttcagagtatgaaatagacatccataaaccaatacacatattaataagtgatcaaataaagaaataataggaagaggaacacatctttttacagaagtattccaaatatgttaggttgatagtcctctaatcaagtaggtgaagcttaaacactcatgagttgattgtagcctgagattagagacgtggaaaaagtaattgctattactgtattttataatgagatttcagatataataccaaagacatgatctgtggatgaataacattttacattttttaaatctaaatttgtataaacacacacacacacacacacacacacttttctgcaatacatactgataagggagtaaaagacagccgcagacttggagaaaatacttccaagtcacatatttgttaaatgaattcttttaatttgttaaatgattttataatcaatatgcaagtaaacttacaactaatcaaaagaaaacaatgcagttaaaaatgaaccaaatatgagaagaggcatcttggcaaaaattatatgaaaattgttaaatgtgaatttttattagggaaatgtgcatttaactaaaaattagataccattactcacctattagaatggttaaaacacacaattctcataatgataaatggcaatatgaatgtggaaaaccaagaactatcatgcattgatggtgggaattcaaaatgctacatgcacaaaatgagtttttttggcatttttaaaaatagagataaaagtagagataaaatgtgatttgtgtgtgtgttccaaaatatttacaacactgattcagaaattgatgtttacacagatacctacagaggaagttctgtatcagttttattaattcaatccctgaaatttgcttgcagaataaatattgtatgaaaaatctctcaaataattaaaatttctcaaatacacgtttatattgttccttttccttaatgacttaatatcattttctgagaaagtcttcaatctaataatctttgtcatttcctccatgccagcacagctgcttcccccctggggtttctgacactctcaggatgtgggttttcacactgtgtctctcgcacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacctgtagagaagacacaggagtggatggaagcccccttgactggcttcgatcccttcctcctcactgggatttggcagccccttacctgtggctgctgccaccaaaaagaggatcctccaggtccagtccatggtgaggagttgtgctctgggggcttctgaggagggatgtggttgttgggtgatgctctcagggcacaaagatatctatagtcatctcagttatttgcatattcatgagcgatgctatttcatacctaacacagcatgagaaagagtggagagatgacacatggattacccaacaggaggatgctaagggttcaagctataatccccttagaggccatgtgtgccctgccatatccctaaactgtatgttgacagagcttctcccactggagaacaattttccctagaacaggacttcactgggaacccacacttgaatagctcagaggtaatttaaaatatttctaggctttaatacatgaatgtgttatttgggggatgagtgtgtttctccaaaagttgcacttatttatataaaataaaagcttaattgacctccagatgcttactattaagatatgtagcagggttagaaatctccagtgtaaattgataaattcttgcagttgaataggatatttatggactcttcagcagtttttgtcaaatacttattttagatttttttagaagaatgacacagatcttaaggggactccatccgcagcctcctgtgcacctgctctggggctggagcctgtgctgggtgggccttgagcgccccctgcagcccagcccttgcactgcagagaggctcctgtctgggctcccagagcattttccccccagtatgaagtggctgtgtcctggctcagaatgctcctttagtgacacgtgacaccatgtgctgctgacgccatcgcttgcaatggtaaattggtcgtaggaaagccagtgaactctgcagaaacaccccaagcaaggattctatgaaaccaccagggagccccttctgtggagctctggaagcactggatcagtccacactcacagtgagtccaggagcttccaggggctttgggagaacacctaatctcttgtcggttcctgtggatgaacatctcatcagataatttctaaacctgcaagatcatgggtctcagaggccactgcaaaactcctaatacacacacacacacacacacacacacacacacacacacggtggttagagtccccacagtaatggacacacacacacacacacacacacacacacacacacacacacacacactgtgtctagtgtcctcacagtaatgggagggaactgtgccttactccctgtgtctcgcgcattggtcgtgcgcccacagtgcccctaggcctggggatatgcccttgtcaacagagcgacagcaaacactttactggagatggggccctgcacacactgtggcttccctgttctcccagaacctgggatcctgcagatacccctaagaagagtccaggctccccctgggagggtcagccacagcccagccccaccgagtcggtgcagcctgcactgagccgctgacctgtggagagggtcacgccagacccacagcccagccagccccactcccagaggcacatcaaggaagggggcagaaccctggggactcttgatgggcatcttttcaggagcagacacacgaactgttccaggaacaggggacctgggaaggtcagtagctggtcagggtttctgaggaccagcgtcagtgatgggacctgcctgtcccttctcatatgggatgtctctcctggggatcctgcactgtcttatttgtgcaggttcactctgtgggacttgtctttataaatctcaaatctcaggaacaggagagctgtgcttcaaaagcccccatagagaagacacattcccatcctgctgtgactgaaacagctccatcctgggcatggggagggctcatgtgtcccacctgggatgagcagcagcagccacacgtgagctgaggaggactcaaggctgcttcccagcacttccccacagagtgaaatttgtgtgtttgccccaaatccaggctggccctgtgacttgcttctttcaaacttcttggcctggaaagtgcaggcaccagctgtcactgtcaccactattgtgacagtgtacacagcaccaggacaggatcccagggatggggctgaggacagacactagctaagtggacccattgaaaacgtgcggatctgctgaggttcacactcctggaaggacagatcttggagggtttggaggaggaagcagccactgtcggtgactcaggatctgctgctctgcgggtcacctcgttggcaagtaacagtgggcaggtgagtgtggttcatcccctacagggacaccaggcttccaaatgcccctcttcaccaggaaagaaagtggctttgttcatactggttgctccagccgtctggtcatcctgtcttcctgaccttcttcccgtgtccctcagggctgtgacacatggacaaagacactttctactccaaccattgattccccaagccagctccctctagaaaagccacgatgtcttcctggttctgtgtccctggctgaaccagaatggacacacatggatataccaaagtgtcaaagtggaggagaggaatcttggcaaagatcactcaggaaagagaaaggaattcatttctgtgcaatgagagggtgtggggcatgtctggaggctgcaggagccagaagcttcatatttttttagtgacctcggttttgtctcccctgttgttgtgaggcttccctgagttctcctcctcagatagactctgtgccttttcacgcaatgacctataggagatgtttacaccaaacaaaaagcctcaaacctggtttatattctgatctaaattttcaaaagataaacccaagagagattcaaagaagtgattataaaatatcaggatatagcacttggctgagaaaaccttaaactcatattatttttatgaaccatatgcataacaaaactgcccaattcctccactttatcagagactgcctgcaggatgaatttcaatgccacctaatttagagtaggagcaaaacttaaaatcctctgtaggtctgagtgccactaataacaacaacaacaaaaaatttcaaccattatgaagttttaagagatgccacaatgacagcctgggttgataggtgatggcattttccctgggcatattctgtgaagagtgattacggtagctttttcttctaatgaggagaaagcaacagagaaagtaaaaaataataataataacaataatcacaaaacagaaaaaagtggtccaaattatttaacaaaaaaagcactagaaactgacacaaattaaaaggagatacattgattacctagcagaaaattcaaagtaaaccttataaatatgttcactgagctaggagaagaatgcacgcacaacatgaaaatattaacagggacaaaaaagggagagaaatgagatacgatgatttgtggcttaacagtagggatacattggccaggcgcagtggctcacgcttgtaatcccagcactttgggagggcaaagtgggtggatcatgtaggtcacgagctcaagaccagccagggcaacatggtgaaatcccatctctactaaaaaatagaaaaaaagaattagctgggcgtggtggttcatgcctgtaatcccagctactcggaaggctgaggcaggagaatcgcttgagcctgggaggcggaggttgcagtgagccaagattgtgccactgcactccagcctgggtgacagagtgagactccatctaaaaaaaaatgaaaaacagtaggaatacatctgaacaatgtgtccttaggcaatttgtcattgtgcaaggatcatagagtgtgtttacacaaacctacatgaaataccttgctacacccaggctgcgtgggatagcatagtgctcctaggtaacaaatctgtatgtcatgtaagtgtagtgaatactgtgggcagctgaatcaccatggtagatgtttatacagatgaacatatctaagcatggaaaaatgcggtgaaaatacagtattataatctaatgagacctttgtcctgtaggtggcctgttgttcaccgaaatatcatgatgtgcatgattctgttcaagttgctgaaaataaaaacaaagccaagaaacttccaaataaatacgttacatggattaaagcttttcttcaataatgcaggaggtttgagaagttccccaaaaaagtaaaaagtggacaagttcatcaccactagactggccttacaggaatgctaagtgtctctggcaggtttccagaacaaggaagtagctgcatcagctccactctgttatctgccaattgatagatttgcatagttttaaattttaatttatcttctttttttttccctccataaactccttctcccttcctttcataattctgtctattaatgcaactcttatttagctgaaaatgctggggtcattggaataaatttctatttttcctccaccaaatctaataagctgtctccaggggtgtccatctccattttcttttctgccattcccatgggataatttccttgttcctatgtgagtccagccctcaacaccatgggccatccaaccatcatgcacccaggaacagcttcaggaaatgtaccctgccagctgcctatcatcctccacctgcacagtgatcattccttcagctttcactcatgctggagggctttccacacaaaagggcgtttcacacccactcccagcacagttctgggaccctgtatacctcccagagacaggtacatatccttcccctttgttgttaattttgtttaatttatttaaaattcactgggaaatcactgatgatgggagtgaccagcctgtccattccatctgacggccccacctgtaaggttggccaccctagtgtgctgtgctcatggggccatctggacacacacaaacaccaggtgtgtgagttattagaggagacccggggtcagcagctgtctgtgccccacaggacacaggtctgtcctgcagtagagcctgcatgacctggaatcatacatgtgcatgacccggaatcatacatgtgcatgacccgtggtctcagcacatcagttgaggccagcttcaggcaattcctgtgtaacctgccctgagtgcccacagaggacagatgcatgacaaggatgtaagggaatgatgtgggttaggggaactgaagctcaatctttactgaggctttactcagcacctggaccttatggaagactaagaagaagagaacaagagcccggccccaaatatctcctggtttaaggtcagctttagtgggattttagagagtagaagacacaggggtgacgctggagtggttttctttgggatacttggggagcagcagaaggtgggccgggatcaggactccatctggctggttctcatgatctacatggattctcatagtggaaagtgagagacatgacctagaacacagccccccagggctgatctcagagaagcctgctaagtgaatgactcagcagaaatgtggtggggttttcatcttggatctatttttctttataaaaataatctgagagatgtgtcagcctcggtgggctgcttctccctccaggagacggagctaacacaattgtatctgtgaatctgcttggctttccatcagaagataccacagactaggttgtttcaaataacaaatattaattttcttattgttctggagccttgacgtccaagatctgggtgaagaaagggttagttttttgagaggccacttccaggcttgcaaagggccaccttctcatgcagcgcgtccccacatggcctctcctctgtgtgcatgtggagagagaggcctctgatgtcttccacttcccataaggacaagagtcctagtggattagggtcccacatttatggccacagttaacttatttgccttcttaaaatccctctctccaaatacagagccactgggattggggtttcatcacatgaatttaagagcaggacacgatgcagccgatgacgccaatcaagagatggtgagaagccttgaaatactttgtcaagaaggtaaaatgggccttgtgggaatttgttgaaaaaaaggtgccagtgactgttaaaaccttaatggtaaacagagaaatttctcccttctttcttgcctgcagcgaggatgtgaggaagcagaaccacagataataaagaaagaggaggcctggggacagctgaggtcctggcgaggagggagagcactgagctgatgaggaagccccgccctccctgcacctgctcctgacccggcctcttgctctgtgggccccgcgcgccccctgctggtcttgagcagcacctgcgccggtcccctccgcctccctgcagggaggtttgtgtctgggctcacactcacctcccctcactgtgtctctcgcacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgaacagagagacccacagtgagccctgggatcagaggcacctcccatatccccatgtctgcagccttgagacactcacatctgggagctgccaccagcaggaggaagaaccacaggtgtttcatgttcttgtgcaggaggtccatgagtctcagaaagtatttcccatgtgagctggaccctgaatttaaggaaatgtgtggtggtttcctgtgggtgcctgagtgaggatttgcatgtaggtggtgcctttgtataaagaggtgaaaagggatgagggaggccccagtcttttaggctcaccctgggatgaggatgcttgctttgccctttgagaactcagttctcttcctggggcctcaactagccatgccctggctcctcttttcccaggtgaggaagtagattggaacagcagcttaacgtaataatcatgtgagttcagacacaccaggattcacttaatgtatagttcgggacctccatcatgtttagagggaatctctctgttctagggagtgggccattttttaaaaatttttaaattaaaataaattttttagatgaacttttgctcctttgcccaggctagagtgcagtgtcctgatctcggctcaccgcaacctccgcctcctgggttcaagtgattctcctgcctcagcctcccgagtagctgggagtacaggcatgcacaaccccccccgtctaatttttatatttttagtagagataaggtttcaccatgttggccaagctagtctcaatgtcccgacctcaggtgatccacctgccttggcctcccaaaatgctgggattacaggcctgagccaccattttaactaaggcactgggagctgccctctgagaccttttgagtcctggaattctttctgagaccttaggaaaaactcgtgggacatatcttcatcattctcaatgtgtgaccctgaggatgtgtcctgacctctgtacacttctgtgtgaaagagtagattgtgaattgcagtgaaaatttcatatgtaaactctataataggtcagcactggaggatattctcattaccaagattactgcagttacctttcctggaaaccagagaggaattctgtgagccctcacctctgagtgcacaaggaaccctggtcctgtctgacaggtctcacatgtgacatgggggaaaacagatacattcaagtccagtgttttcacccatatattgaccaatctagcctgatctatctgtctctgaaaagccttttccttcactgaatgcatgaacatacccttgggtatggggtattgcaatgtgggtatttggtatttgtttagtgaattatgtaattaataggctacctccatgaatgtgtgtaacagtagagttatcagaagttggatgagtcatattatcaggacaaacctggactctcttcttgggacctggacaagtggccaatcttctgtggtaaagcaaaggggaagagacagatccaacatccagaagcagggtagctcctcacttactagctggtgtctgagcatttgttagaacagatgaaaaacgacctaccttcaccttcagggaaatgatgaacttcgtatgaaattgaggttaattttcacttacagagaagaaaatgtcataggcatgtatatatctatgtgggtgtgtacgtgtttccaggatgtgttcatacacagaaaagaagcagctatatttgctgggaagacaaccgaagagcttctgaatttgtaggtgttgttaaccacaaatgtgtcatgttactacatcgtgtcatagtgctggcggtaaaacctcccaaaattgtcatggagacaaatgcaaagaaataaagattcaaatcagatgcctttgatctgtaatgaacagaccaagaaatcaaccattatggaaagagtgatagttaaatgtagcagtaaattccacgctgaggtgagagggaagttccatctgacagctcactttcacctctgggaagacttcagagcacagactaagagcagagagtcaacttagggcaagtgggggccagatgtttgaggaggatggagagtgagctggagtccttgtgagccattcagagaagcagcagtgtgcaagggtgtattgagtcctcctgagttaacaggtgctgagcagataccagtttcactgccctcattttgatttatcctcaagagtctattggatttctagatttgaacactggaaaagttgatgaaactcaacatgactaggaatatttctgggaagatttatgtaatgatgtgagtgtatttaaaattacattatgaaaatttcattatctaaaatgttggtatcagtatctattgatttgttctttttttcttagagacagggtcttgctctgtccctcaggctggaatgcagtgtcatctatgaattttatagtattaaaaatgatcaccctgattaatgttaccgtattatccccttgagggattttgctccatgtgtgcctgtgacatagttctagtcacagatgcaggagaagtggtctgttgaggcaattcttcctcctcagaggagaatataaactatcatctcctctccttgcttattccattttcagaattgcacacgacctttgggaatggtgtcgccatgtcttacacggtgggagtcaactgtggcatgaagctggaatggagatgtgtaattttgggaaaatacagaacctgggcacataaagttttgaattaattgggcctggagccactcacatcctggcatcttgttgaattgtttgtcattttaaattctggttatttagttcaagtttccttgattctctttctgctaaaatagtcattcataatcatctaaataaattaaattggaaaaaaattactaatttgaaaattaatcccgtttctgctgaggtcaaaattagtttgcggtgcacagagtgatgggcatggacatagaagattaccaagattgcactcacagcctaggtaatcactacattttatttaaattaggaaacacttctgtacattccttatatttattaaactcctgttgagaaacttcaactgttatatgttgatggatcctgcccaataataaaactaaatgtttttaaacacgaattcctattacaatgttagctttactttaggacacatttcttcacctcatttcaaattggcccagatgcactgattagagcgtgtcagttaagaaacgaccaggaaatgagatcacgtttctggagcaggacatggctttgggatgctttgcaaacaaagtggtttctcatgtcttcttgaaaatccattgaaatgggcaagttaaggacctcttagaagcactcttccatcccatatacttgactaataaaaaggtggaagtcagtgcggaaaaatagataacatgaaagctaaagtaagatttgtaccagttcattgcgccaaacatgtaatcttaacctagagtaggatcttatctgaaccctcaggaggtaaatttcctgagagattcaaagatgtctttataaaataacaacacttagcccccgattttatgttaaaataatggaaaactcctggtaatctacttcactcagtgtaaatcagttaaaaacaaaattctggaaaacctgagaaggtgggacttgccgaggaactgagccttgggggcctttggacacttctagttggattttcttcagctttgactctccatggaatttgaacaagtttcgtttactgtctgctgtttttctgaatgacttgaagtaattccttgacaaaagcctacaaccttctcagttgatagacatattttatgttttcaacctgtgacatgcagatgttttcatcaggtaactgaagcaacccactacaggaagcaactgttataaagtgattctgtaaggtgtttccattactcaaatgctaaactgctattaccagcaacaatattctgtaaatgttgaaaaaaatggcattgctacgtagaattaatcacaaattttaaaactttttcatatatttattgtttaaattcataagcatggaatgtttatttttccatttatttgttttatctctgatttttttcacatgtgttttgctgtttttctggtagagatatttcatctcattggcttaactctattcctaggtattccactgtcttggtggctattgggagagcatgttcttgattccactctcagccagaacgttgttggtgactagaaatgttactgtgattttcgtacattgattttatatcctgaaacattcctaaacgaatgtatcaatactaggagacttttggcagagccttcaatattttctacatatagaatcatattatcagtgaaaacagagggtttgcattcttctttttcttttatttggatgccttttatttctttctcttgcctgatctggtgaatacttccagtactaggctgaatagaagtggtgagagcgggcatccttttcttgtttctgttcttaaggaaaatgcttccagtgtttgcccattcagtatgatgttggccatgggtttgtcatagacggctcatcagattgaggtgtgctccttcaatgtctataattttgagggtttttatcatgaagcgttgttagattctattgaaagcttttttcctgcatctgctggaatactcacatggtttttgcttttgattctgtttagtagagcatcacatttattgctttgcataggttaaagcacttgtacagtgctggatggaatgtgaattagtccaagcactgtggaaagcagttaaagcagccttgcttttgcagaatgtagcctacttgattgcagtgtgttaactttttgataaactactggatttgatttcctacgttgagaatttttaagcctatgatcatgagaagtatttgtcttgagttttcatctcttctcaggagcagacacaggcactgatcaggaactggggacctgtgaaggtgagtagccggtcagggtttctgaggatgagtgtctgtgatgggacccgcctgtcccttctcttatgggatgtctctcctggggatcctgtactgtcttatttgtgcaggtccactctgtgggacttgtctttataaatctcaaatctcaggaacaggagagctgtgcttcaaaagcccccatagagaagacacattcccatcctgctgtgattgaaacagctccatcctgggcatggggagggctcatgtgtcccccgcactgggatgaacagcagcagctgcacgtgagctgaggaggactcaagg
